United States Patent 11,376,284 (COMPOSITIONS COMPRISING BACTERIAL STRAINS) - sequence listing, part 2

SEQ ID NO: 5 - DNA, 3415035 bp, Blautia stercoris strain 830 chromosome (residues 1,707,519-3,415,035 of 3,415,035)
cgattttaaagccggtcagtgttatcagtacttctattgatcgtgtaaaaaccggggatatgcagggatatatttcaatagaaggaacaaatgaaatctggcagttagcacgggaatataatgagatgttgtgttcgattcaagaggcaaatatgaaagtagaagaacagcatggagaaattattgaatcaatgaaaatgaagcgcagggcagagagagaagcacttgaatcgcagattaatgcgcattttatctgtaatactttaaatgcgattaattatgaggcaatggataatggggattttaaagtctctttgctgcttaaaaaactttctaatattttacgctatacgtttgatcagaaacatcagaatgtgtatatgtttcaggaaatttcatggattgagcagtatctgtttttacagaaagaacgaatgggaagtgcctttgattatgaaattcagtttgattcggattatgataactggccgtgcaggaaactgatgcttcagccgtttgttgagaattcgattcttcatggattagaaggggtcaataaaggtggatttatccgaattaccggagaaggatatcaagagtatcttaaaattgtaattgaggataatggatgtggaatgaccccggaggtagaacagattattaaagaagtgttggagaatccgttgcttgcaaaacaaaaaggattgggaatcggaatttctaatgtcgtaaccagaatgaggatgtattatacagaagatttaaagattcagttagagacagaagagcgaaaaggctgtaagtttacaatgatacttccagaggcaagacagtaggagacaagggggaaggcagataaatgagaatattgatagcagaagatgaagaacgggcgaggagaggacttcattccgttttaacttctttatcagaggattatgaggtagtagcagaggcatcgaatggaaagcaggcattagagttgcttcagatcctaaagccggatgtggtttttacggacttaaagatgccatttttggatggaatgggactgattaaggcaggaattgcagcaggtgtttgcacgaaatatgtaatcgtaagcgcttatgaagaatttgaagtggcaagacaggcaatcagcctgggagtaaaagagtatctggtaaaaccagtaacttatgacgaattaaaagatacgatggaacgtctggatgcggcgcagaaaggaaagcctcagctcattgataaaacattaaaagaacggtacccggatgtgcatccattggtgagaaaatctctgggatttattgaaaaagggtattccagtaaaatcagtcagaaagagctggctgctaatcttggaatttcacaggagtatttttgttatctgtttaataaagacatgggagaaacattttctcattttttaaagaattatagaatagaagtggcaaagaagcttttattaaatggagaattgcccaaagaggaaattccgtatagtgtaggattttcagattccaaatattttaataaagtatttcgagaagtggaaggttgcacaatgacggaatacgttcggaaaaattcagaatgattcatacaaaataccagaataaatatgtgtgcactaaatgcgtgtggttaaagtgcatagtattattctggttttttgtgatctatcttaaaaaaatacccgaatcttaaaatcgtatcttaagattttacctcttatcttaagatagtaagttacgaaaaaaacctaaaattattataataataacatcttaattagaggaggaaaaaaattatgaagagaaggttccagaaaatcgcagcgctgatgctggttggtgcaatggcaggtacactggtcacaggttgtggaggcagtagctccggttcatcctcagagtcaagcagtgatagcaaagaggcgagcgacagcagttcttccaattcaaacggagcagcagaggttacgctgtggcattatttcgagcatgaagctccagaccttgaggcggtagcggagaaatacaatgagtctcaggataagattcatgttacatgtacttatgtatcccgtgaagaattgatgaaccagtacacaatcggtgcagtatcaggagagcttcctgacatcggaatggttgattcaccggatatggaatcctatatttctcttggtgtatttgaggacatcacagatgacatcaaagattgggatgaattagaccagttttatgacggacctctttcaagctgtatggatgcagatggtaaatactacggacttccaaacaattcaaactgtctgaccctttgctgtaacatggacatcttaaatgcagcaggtatcgagaacccaccaactacatgggaagaatttgaagaagcctgcaaggcaacaacaaatgcagcggaaggtgtatatggatttgcaatgtgcgatatcgctacagaagaaggtactttccagattctgccttggatttattccgcaggtggaaacattgatgatttgacaagtgctgaatcaacaaaagcagttcagttcttaactgacttagtacaaaacggttacatgagtaaagaagttgttaactggcagcagtctgatgcatacaatgcatttacaagtggtaaagcagcaatgtttgaatccggtacatggcagttagctgacattgatgagaaaatcaatggttctttcaattatcagtatactttacttccaaaagataaagaatacgcttctacaatcggtggagaaaactttggtgtctgcacaggttcggaatacaaagacgaatgtgttgacttcctgaaattccttatgaatgcagaaaacaacgcagactttacagcagcagctgcaaaacttccggttcgtaaagatgctgtaggcttaaaagacctctggacaacagatgacagatacgttgtatttaacgatgctatgaattatgcaaaagcacgaggaccgcacgctcagtggccgactctttccgaagcactttatacaggtgttcagcaggctctgcttggtgaaaaatccgtagaagacgcaatgaaagaagcgcaggctaagattgacccgattgttgcagaagatccacttcctgatttgacaacaggcggcggagttgcagacgacgtaaataagtaagaaaaaaataagcagtaataagaaagagtcctggaaccggtctgggtttcgggactcttttaaaatgaaaatcttgaaattccgtgagaggagtgtgtgaagatgaaactgaacatggctgcaaagaagaggagagaagcctatatttttattcttcccggttttatttatctggttgcaatttgtggttatcctttgatttacaatctgattttgagttttaaaaatgtaaacgtaaaaaaccttgccaccggtgcatcggtttttgttggacttgacaattataaacagctgtttgccgacccgacattccagctggtatttaaaaatacaattgaatttacactggcttgccttgtagttcagtttacaatcggctttttatttgcaatgtttttctcaaagaaatttacactggcaggaccgattcgaggtctcgtgctggtgggatatatgatgcccatgtcggttacagctttacttggtaagaacttattcttactcgatggtggtgttatcaatgacctgttaatgaaggttcatctgatttcgtccccaatcgactggctggtaaatggcggaactgcacttggagcagtcattgccgtaaactgctgggtaggtattccatttaacatgttactgttaacttccggtctgaccggcatctcaactgatatctatgaaagtgcttctatggatggagcaaatgcatttaagagatttatctacataacactgccgctgatgaaaccggctatgctttcagtattgatgcttggatttatctatacatttaaagcatttgaccttatgtacattatgacagcaggtggtccgttcaactccactgacgtacttggaacttatgcatattcaaaagcatttacccagtatgaattttcacagggttctgcaatcgcaatggtattatttgcctgcctgttcctggttgggatcttctacctgaaactgttgagtaaggaggatgactagaatgagtaaggaaagtacaaaatcagcaaaagtcgcatatctgaaatcaaaagagggacgaagcaatgtcatcaattgcttttgggcaattataatcgcaattatcttcttgttcccaatttactggctgattcagatgtcttttaagacagatatggaaagttttggaaaaatcgtaacttattatccacatgaatttaccgttgatccatggctccagaacttgcaggataaagactttattacctcattaaaaaacagtgtatccattgcactgtgttccatgtgtttatcactggtatttggtattccggctgcttatggtatggggcgttataaagtaaaaggaacaaaaagcttcatgcttacttttcttgtaactcagatgctcccggcatccgttatgttaacaccaatgtacctgattttctctaaagcaggtttacttggaacttatcttgcaccggcacttgcaatttcctccggttcggttccgtttatcgttgtaactttaagaccatactttaagagtattccggtttccctggatgaagccgcacgtattgatggatgtaatgtattccgttctttctttaagattatgattcctacaattaaaaccggtatcatcaccgtagttgttatctctttcttaaatggatggaacgatctgatttattccatgacatttaacgtaaaagcagacatgagaccattgacagcaaatatccataaattccagagtaaatacggaacaaaatggaactgtattatggcttatggtgcaatccttgttattcctgtaatccttgtatttgtattcttacagaaatacattgtaggtggtttaacagcaggtgctgtaaaagagtgatgctataaaaataataaataaaaaacaataaaaaaataaagaaaggaatcaaaactatgccagattttgtaaaaaaagagggtgcaccaacaggtgacttccgctcagacaacaactttttattaggttactttgaggaaaaagaccattctctttactaccgctatgatgcagagagagttatcattgaaccttggggagataacagtttccgtgtccgtgcatcaaaaatgcctcaaatgccggaagaactttgggcattggatggaaaaccggaaaatcgcagctctgaaattacaattaaagaatattccgcagaaatcgtaaatggaaaaattaaagcggtaatcaacaatatcggtaaaatcagcttttataatcagaaaggtgaacttctcttagaagaatatgtacgaaacagagaagatatgtttgcagaaacctgtagttctctggaagtagaggcaagagagtttaaaccgattatcggtggagattatgagttgacgatgcgttttgagtcaaatccaaatgaaaagatttacggaatgggacagtatcagcagaaattcctggatgtaaaaggtgcagaacttgaactggcacacagaaactctcaggcaagcgttccgtttgcattatcttctcttggatatggatttttatggaacaatccggcaatcggacgtgtaagcttcaataaaaatattacaacatgggaagcacgttctactaagaaactggattactggattacagcaggagatacaccggcagaaattgaagaagcttatgcagacgcaaccggaaaagttccgatgatgccggaatatggacttggattctggcagtgtaaattgcgttatcagacacaggaagaactgcttgaagtggcaagagaatataaaagaagacagattccgattgatgttatcgtagttgactttttccactggccaaaacagggtgactggagattcgacccgacttactggccagacccggatgcaatgattgcagaattaaaagaaatgggtattgaactgatggtatctatctggccgatggttgactataagagtgaaaactttgaagaaatgaaagccaaaggtctgctgaccagagtagaaaaaggtgtaagaatcgataatgtttacatgggaaataccattcagtatgacccgacaaatccggaagcaagagagtatgtatggggcaaagcaaagaaaaattattatgataaaggtgtaaaaatcttctggctcgatgaggcagaaccggaatacaccgtatatgatttcgaaaattatcgttatcacttaggaccaaacgtacagattggtaatgtttatccggcaatgtatgcaaaaacattctttgatggcatgcgagcagagggacaggaaaatgtagtcaacctgcttcgctgtgcatgggcaggaagtcagaaatatggtgcactcgtatggtccggagatattcattctacatttgaaagtcttcagaatcagtttgcggcaggtcttaacatgggactttccggtattccgtggtggacaaccgatattggtggattctttggagcaaacatctatgatgaagattatcatgaagtatttgtacgctggtttgaatatggaacattttgtcctgttatgagacttcacggttatcgtatgccatatcagccacagcttggaacaaccggtggtgcagagtgcgtatccggtgccccgaacgaaatctggtcttatggtgatgatgtttacgaaatctgtaaaaaatacattgaaattcgtgaggcaatgcgtccatacacaagagaactgatggaagctgcacatgaaaaaggaagtccggttatgagacctctgttctatgactttccggaagataaaacatgctgggataatgaatcggagtatatgtttggaccacagattttggttgcaccggttatggaacgtggacagaaaacaaaagaagtttatctgccggcaggtacaaaatggacaaacgtatggacaaaagaagtatttgaaggcggacagaccgttacagtagagacgccaattgaacagattccgttatttacaaaagaaggatttgaattagaagtataaaaagattctgatgatatgtgaaaagtaaacgggtgtgctgcactggttgccttggatgcagccggtgcagcacgttttttatgggggatatttgagatgattacacaaaaaggaaataagatttacagacgacaggataaggaattactttgtattgaaccatggggaaaaaacagtttccgtgttcgtgcgacacagcgttatgagtttgtaccggaagatatttctgctttacttcccccacaggaatgtaaagtaaaggtatttgaagaggatgactgcacggtcattgaaaatggaaaaatccgctgtgaaattacaccgaccggaaaactgcgtttcaaaaatcaggatggaaaactgttattagaagagtttgaacgaattcgtgcggattacagaaaagagtataatagtgcacttgagattgtgccaagaacgtttgagccgcatcagaatacggataatttcagattgaccgtaagatttgagccgattgacggtgaaaaattatatggaatgggacagtatcagcagccatatctggatgtaaagggctgtaccttagaattggcacagcgtaactctcaggcgagtgttccgtttgtgctttctaataatggatatggatttttatggaataatccggcaattggacaggtttctttcggaaagaatgtgacggaatggactgcagtttccacaaaacagatggattactggattacagcaggagatacaccggcagaaattgaagaggcttatgcggatgcaaccggaaaggttccgatgatgccggattacggaaccggattctggcagtgcaaactgcgctacatgactcaggatgaaatccttgaagtggcaagagaatataagagaagaaagcttccgatttctgtcattgtagtcgattatttccactggccaaatcagggtgactggaaatttgataccgatttctggccggatccgaaagcaatggtagaagaattaaaagagatggggattgaactcatggtatctatctggccgaccgtagaggaaaccagtgaaaattataaagagatggaagaactgggttatctgactcgttccgaacatggaaaacgtcttggacagcttaatgtggcaagtgtgattgatgtaaccaatccagacgcaagaaaatacgtgtgggaaaaaattaagaaaaattattatgatttaggaatcaaaattttctggttagatgaggcagagccggaactgaccggatatgaattcagtcattaccgttatttccgcggtgcagatatggaagttggaaatatgtatccgaaagaatatgcacgtatggcttatgaaggcatggaagaagaaggtcaggaaaatattgtaaatctgcttcgctgtgcatgggcaggaagccagaaatatggtacattggtatggtccggagatattgattcttccttccgttctttaagaagccagcttgcagctggtttgaatatgggaatttccggattgccatggtggacaactgatatcggaggctttcacggtggaaatattaacgatgaaaaatttaaagaagtgctggtgcgctggtttgagtttggagcattttgtccggttatgcgtctgcatggattcagagaaccgtttatcccaggtttaagtgaatccggcggtggaaaacacaggagtggttctccaaatgaagtatggacttatggtgatgaagtacttagaatctgtacaaaatatcttgaattaagagaaactatccgtccttatgtaacagaactgatgaaagaagcacatgaaaaaggaacaccggtgatgcgtccattattctatgattatccggaagatacaaaagtctgggaaatcgaagatgaatacatgtttggaccagatatgctggttgcaccgattttatatgaagatatgagagaaagaaccttgtatctgccagaaggagactgggtcgatatcaactccaaaacagaatataagggcggagattttgtgaccgtagcagctccgcttgatacccttccggtatttgtaaagagaggaacacatccggaactggtataacagaaacttaaaacaggttataagaaagagggctggaatcaaatgaaaaagacggaaaatatgtttggatttggaggaagttttgtagggacagtagagaaaatatttgacataatggcattaggatttctctggattctttgcagccttccggtcattaccataggtgcatctactacggcactgtattatgcgatggtaaaatcagtaaaaaataatgatgggtatgtgacgaaagaatttttccgttcttttaagttaaactttattccagccacaattttatggatgattcttgcagtgatgacatttatcatgcagttaaatgtaggaatcttaatgaagaaaagcagtggcatggtggggctgttttttatctgcttttatgcactggtatcggtttatctgattattgtggcatgttatgcatttccggcactttccagatttgatatgaatgtcggatggattttgaaaatttcaatgtacatggtcgtgcgttatatttttaccagtatcatgcttgtaattatactggtctgcattggtgcaatcgtctggaaactcccgctgctggtgttctttgtgccaggaccgattgcgtttttgatgtcagaatttttagagcgggtgctcaaaaaacatgaaccgaaagtagaagaaggaggaacagcagaatgaaatttaccaatggatattggatgttaagagatgaaatagaagcttcttatgcagtagaatatgcaaaacatactgtaaatggaaataaattagaggtatatcttccggcaaaacacatgtcaggaagaggggatgcgctgaatattgcacttcttacattgacgctttccagtcctcaggagggtgttatcaaagtatcagcggttcatcataagggaatgccttataaaggaccgtttgcagcagtaaaaaatgaaaatccaaatgtcacaattgaagatacagaagaccagctgatttataagagcggtacattaaaagcagtcattgataaggctccaaatgcatataaactggcattttatgagggcgatacattcttaacagaatccagtttcagaaaccttgcttacatgcataaccgtgaaaccggaaagaattatatggtagagcagctcctgctcgatgtaggcgagtatgtttacggacttggcgaacgtttcactccgtttgtaaaaaatggacagattgtagaaatgtggaacgaagatggcggaacggcaagtgagattgcttacaaaaacattccgttctatattacaaataaaggttacggcgttttggttgacaatgagggtgacgttgcttacgaaatcggaagtgaaaaagtagaacgagtacagttctctgtagaatctgaaagactggattactattttatcagcggaaaaactccgatgggaacagtagaaaaatatacagaattaaccggaaaaccggcactgcctccggcatggtcctttggtctgtggctgactacttcctttacaacagattatgatgaaaatacaacctccggttttattcagggaatggcagacagagacattccgcttcatgtattccactttgactgctactggatggaacggtttaaatggtgcaatttccagtgggatcatgaggtaacaacagacccgaaaggaatgttaaaacgctatcatgacaaagggttaaaaatttgtgtatggattaatccatatattggacagcagtccgaattgtttgaagagggaatggaacatggctatttcatcaaacgtatagatggaagtgtatggcagactgatttatggcagccgggaatggcagttgtagactttaccaatccggaagcatgcaaatggtaccagagcaaattaaaagcactgcttgatgatggggtagactgctttaagacagactttggtgagagaatcccggtaaaaggaattcagtattatgatggttctgacccggttaaaatgcataactactttacattcttatataataaggctgtatttgaagtacttgaaaaagaaagaggaaaaggcgaagcagttttatttgcccgttccgcaacggtaggcggacagcagttcccagcacattggggtggagactgctctgcaacttatgtatcaatggcagaaacccttcgaggcggactttccctttctgcgggtggatttggattctggagtcatgatatcagtggatttgagcagactgctccggcagatatctataagagatggtgtcagtttggactgctttcttctcatagccgtctgcatggttcttcttcttaccgtgtgccgtggttatttgatgaagaatcctgtgttatcttaaaagaatttgtaaacttaaaatgtcgtctgatgccgtatatctatgagcaagcggtaaaagcacataaaaacggaacaccggtgctgcgtccgatgatgctggaattttcagaagacagagcctgcgactgccttgatttacagtatatgtttggtccgtctcttttagttgctcctgtcttcaaagaaagtggagaagtaagttactatctgccaaaaggaacctggattaacctgattacaggagaaaagaaagagggcggaacatggataaaagaaacgcatgattatcattctcttccactgatggttcgtgaaaataccatccttccgatgggagcaagcgagacagaagcagaatatgattatgccgatggtgttacacttgtactttctgaattttcagatggagcaagtgcagaagtagaaattccggatacaaaaggaaatacagttatgaaagcttatgcagtccgcaaaggcgatgaaatcgaagtttctgtagaaggcagaaatggtaactttactgtgaaaaatcttggaagcggaacagttgttgtaaaataattacggtttctattctataataaaagtatgtaataccatacgatgcgacttgacaatttgtttgtcaagtcgtattttattttataagaaataagaaaaattttatcattaagacattggcaactatcgttaaatatgttacaataatgttacaaaaaaattaaaaaggtgagaaaatgaatttatatgaagcgatatttttaagaaaatcagtacgaaattatgagatggaagcactcaaaccatcactgcttactgagataaaagattattgtaaacagatagagggattaaatccaggaattaccacggatatttcaattatagataataccaaaggacagtataagagagttcatctgctgggagtaaaagccccgtattatctggcgttttattcagaagataaagataaggcaatgttaaatgcaggatacattttagaacagttagccttgtttttatgtacaaaggggcttggaacgtgtttccttggaaatgtaaaaccaaagtttggaaataccaataaaggaaatatgaaatgcatgattatgatggcatttggaaagagccggggggcacataccagaaagccgtcagaggcaaaacgaatgagccttcaggaactctgcgtttataaagaagtaccgcggcagtgggtgaaacagcttttagaggcagcaagacttgcaccgtcaagcatgaacagtcagccatggcgttttgtggtctatgacaaccggattcacgtattttcaaagaagcataatatcacttattttggtatgggaaaatatgatgaatttaatctgggtgtgatgttttcacacttaatgattgtagcagaagaactctggctggatttggatttgattcgtctggaggatatttcacataagaatttttcaaattgtgattatgtgatgagtgccgtactgcgaacctgataaaaagaaaaaagaaacgtactcaatcgatagaagaaagagtacgtttcttttttgtattttgattataatacgatggaaaaaattttgtttgtttaaacaaaaagagcgcgagacgggactcgaacccgcggcctcgaccttggcaaggtcgcgctccaccaactgagccactcgcgcatgtcttaacgacaagtgatagtatactatagagatatgagaatgtcaatactttttttgaaaaaatttagaaaatagaatttgttactttattggaaaaaaggatatgaatgtggtatactaaagaccagaaattcagagacttaaaataacctttaatcaaggaggaattccgttatgaagatgatatttgcaattgtgcacaaagaagatgaaggatttgtagtagaacgtctgaataaagaacatatcagtgtgacaaaactttccagtacaggtggatttatgagaaaaggaaataccacactgatgattggaacagaggatgaaaaagtagacactgcaattcagattattaaagaagagtgttcaagaagaaaagaaatgcttgtgccgacaccaacttattctgagggaacaagagcaccgatactgggatattcctcaccgcaggtcacggttgatgtgggcggtgcaaccgtatttgttgtagatgtagaacagtttttaaaattatgatgtgagtgtcaaaagtagaaagaatagatagaaaagcagagaaaggaagaaaataatcatggtaagaaaaacaaatgtagtggtacagcaaaatgtcagaggaggggaaggaaccgtagagtttcatcacattcttgcagaagaagaattatatggacatggaaagctttatgcgaaagtagtgttaaaaccacacagctcaatcggtatgcatcagcatgttggaaataccgaaccatactttgttttaaaaggaacaggagtatttgtggataatgatggaagtcgtaccgaagtgcatgaaggagatgtttgtgtgattgaaccgggacagagccacagcatggaaaataatacggatgaagactttgagatgatggctttaatctataacgaagcagcaaaataatgtcacaaattctaaacgaaagtgtgcttgtaaaaccgccgttataatgatattataattagataactattatatcatttacaaagcggaggaacttaggatgaaaaaattaaaagtagtaaaaggcgcaaaatgtatggcatgtctggagtgtgtaagagcctgttcaacaagtttttacaaagaatttgacccagacaaatcctgcatccagattattgacaaaaatggtgacgcaaaacctatggtttgtgttcaatgtggaaaatgtgaaaaagcctgtccagagggtgcaattacacagaatgcaaaaggcgtttacatgattaacaagaaaaaatgtaccggatgtggaaaatgtgtggaagcctgtccatttaatgtcatggtgaaagcggaagaatcaccggttacaagcaaatgtatcgcttgtggaatttgtgcaaaagcctgtccaatggatgttcttgaagtagtagaagactaatagatattgtattagtgtacttgacacattacacgaatcatgaatggtggctgccgcagtttgtctgccggcagtcatttttttctatttaagcatgttaatactaattttaatttgaagtaagtccgctttttgtttcgtgaggtgaacgatgataaaaaaatatgaaacgtcaatctgttccaatcaggatggattagagttatccgttttatggttagaaccggaaaaagaaccgaaaggaatcttacagatttctcatgggatgagtgaatataaagaacgctatcttccatttatgcgatatttatgtgaacgagggtatctctgtgccatccatgaccatagaggacatggaaaaagcgtaaaatataaaagtgatttaggatatatgtacggaggaaaagacgatgcgctggtggcggatttgcatcaggtaagtgtgtggttaaaagacagatatccaaatcttccattttatatgctgggacacagcatgggaagtctgattgccagaaactatttaaaacaatatgactatgaattggaaaaattgattttaacaggaccgccttgtgaaaatccggctgctgatcttgggcttttgatttcgagagcagagaagcgggtttccggtgcacatcacaagagtaaactgttggaattaatggcatttggtccttatgcattgaaatttaagggagaatccagccgttcttcctgggtgtgttccgataaagaagtggtaagaaaatatgatgaatcggaatactgtggttttacgttttctgcggatgcatttgagagcttaatgcttctaatgaaagaaacatacagcaaaaaaggctggaaattaaaaaataaagaactgccggttctgtttttggcaggggcagatgacccatgtgcaggaggcggacgaaaatttgtaaaagaacttcagtttatgaaatccattggataccggaaagtaaccggaaagatgtatccggatatgcgccatgaaattttaaatgagactaaaaaagaactggtgtatgaaaatatatacgagtatctggaaaggaaaaatagaagataaaatatgtcaacaaaatcagaagttctgaagcttttagaagaaaataaggggacttatctttccggagaagaactggccataaaactgggctgttcaagaacggcaatctggaaagcgatgaaaacgctccgtgaagaaggatatgagattttggcagtcaataatcggggatatgcattaagtaaagaaaataatgtattatccgaggaagcaatccgacttgggcttaataaaaaagcggtaagaatagaagtaaaaagagaaattccatcgacgaaccagtatttaaaacaaaaaggaatcgaagaagaatacgaagaaggttcggtggttgtggcagagagtcagagtgccggaaaaggcagacgaggacgacatttttattctcccggaaaatgtggactttacatgagcgttttattaaaaccgaaaaaaacggcacaggaaagtttaaagattacagcagcggcggctgttgctgtttgcagggcggtggaaaaagtatgcaaggtgtctcttggaattaaatgggtgaacgatttatatctgggagagaaaaaagtctgcggtattttaacagaggcagtcagtgactttgaaaccggagatattgaactggttgtagtgggaattggaataaacttaaaagaaccgaaagatggatttcccaaagaactcggagatattgcaggaacagttttaaaagagggagagcatgtagaccggaatcttctggttgcagaaatcgtaaatgaattgttagaagagtccgaaaaagatggaatcccgaaagagtacatcgaaagaaatattgtgccgggacgaaaggtctgggtagcatatggacaacaggagaggagtgtgttcgcaaagcagattcttacagacggccgtctgttaattgaaaacgagcaacatgaagaagagattctgccttgcggggatgtgtctttacgaatccgaaggatgtaaaaagccgtgacaggtaatctggataaataaaataccgataaaagcaccgatactgtcaattccgacatcacgcttggaaggacctcttccatccacgaaggattgatgaaattcgtctgtgcaggcgaaaccgacactgataagtccggcaagcagaatcaaccagattccacggacaccatagacataaagcggaagcgaaacacaaagcgcaagaataaagtattcggtcatgtgggcagcttttcgaaccggaaattccagtttatcggtgtaatactggattcttgtctcatcaagatttttgtcgagcgccttatcggcaacgacaacgatttcacggctgattttctggcttaaagcaccagactgcgctccgctctgtcctgagaaggaaaagattaaatacatcatgcaaagggcaggaatgaaagagagcggttttaaaagtaatataaaaaactttttcataagaatgatcctttcttaaaactttgaactatcataagtgttaataggttagattagactatagcacgtttggctatggatgtaaataaagagaaaaaactaaaaaagcattagaaaagaggaaaacatgagttacgcagatgaattatttgtaaaaatgtgccgtgatattttggataacggtacagatacaaagggcgaaaaagtccgcccgaaatgggaagataccaatgaaagtgcttatacaatcaaacgatttggagtggtaaaccgctacgatttaagaaaagaatttccggcgctgacgcttagaaaaactgcattaaagagctgtatggatgaaattttatggatttatcagaaaaaatccaataatgtcaatgatttacattctcatatttgggatgcctgggcagacgaaaatggttcaattggaacctgctatggagatgtcgtaggacgaaaatttatttataaagaagaagaaacggaccagatggattatgtgcttcgccagttaaaagaaaatccttacagcagacgaatcatgaccaatctctatcagtttgaatatctgcacagcggagcattagatccgtgttgttacagcatgacttatagcgtgacaaaagagccgggagaagaacgtctgattttaaatggagtgttaaatcagcgttcccaggatgtgcttgcggccaataactggaacgtgtgtcagtatgcaattttgcttatgatggtggcacaggtcaatgatatgattcccggagaactggtgcatgtgattgccgatgcgcatatttatgaccgccatgtgcctgtaattgaagaattaattaaaagagaacagtatccggcaccaaaagtttccttaaatccggaagtgaaagatttttataaatttactaccgatgatttgattgtagaggattatcaggcaggagaacagattaaaaatattccgattgcggtataagaagaaaatagaaagacagaggagagattaaagttatgaatattattgtagcagtagataaaaattgggcgattgggaaagaaaacaaactgttggtgagtattccggcagatatgaaatttttccgcagtaccacgaccggaaaagtagttgtgatgggaagaaaaactttagaaagctttccaaatggactgcctcttaagaatcgtacaaatattgtactgacaaaagacaaaaactataaagtaaaagatgcgattatcgtacacagtatagaagaagcactcgaagaattaaaaaattatgcttctgaagatgtgtatgtaatcggaggagacagtatttatgcacagatgcttccttactgcgataccgctcatgtgaccaaaattgatttcggatatgaagcagatgcatggttcccgaatctggatgaaaatgaagaatggaaaattgcagaggaaagcgaagaacagacttactttaatctggaatattcttttgtgaagtatgtgagaaaataaaataaaaaaatccgctggcagttaaaattctgtcagcggattttttatgaaaaaaattaattattcgattacttttaaccatccttctggagcttcgatgcgtcccatctggattcctgttaatgtttcgtataatttctgagtagtcggtcccattttttccattccggaagggaatacgatttcttttccatggtcaacaatcttaccaaccggtgagataacagcagcagtaccgcaaagaccacattctgcgaaatcttttacttcgtcgagataaacttctctttcttctactttcagtccaagataatgttctgcaacataaagcagggaacgtcttgtgatagatggaagaatactgttagattttggagtaacaacagtgttgtcttttgtgacaaacaggaagtttgctccacctgtttcttctacttttgttcttgttgctgcatcaagatacatgttttcatcataaccctgattgtgagcatcaacgattgcatgtaagctcattgcgtagtttaatccggctttgatatgtcctgttccatgaggtgcagcacggtcaaaatcactgacacggattgtaatcggttttgcaccgcctttgaagtaaggtcctactggtgtagtaaatacacggaactgatattcatttgcaggtttaacaccgataacagcgtcagaaccaaacatgtaaggacggatatataaagttgcaccagaaccataaggtggaacataagcagcgtttgcttttacagtttcaacaacggcttcaacgaaacggtcttctgggaataccggcatttccagacgttttgcagaatctaccatacgagctgcgtttaagtcaggacggaatgttacaatgtgtccatcttctgttgtataagctttcataccttcaaaaacagtctgcgcatactgaagaactccggcacattcgcttaaggtgatggtatcgtctgttgtaagaccgccttcatcccatgctccatttttaaaatttgaaacataacgataatctgtttttacataaccaaatccaaggctggaccagtcgatgttttttttctccatttgaatctcctccattctttgcccattgatacgataggtaactataaatttgttttccattataaaactttaatgcgggaaatgcaagagaagttacattgcttttttaagtcatatcagatataattgaaatcagttctggtaagggcaggattggagtgagagaatatgccaaagaatgattggaaccaacttggaaatgatataaaaaatattgtgcaggatgcaattgagacaggagattatgggcgcttaaatcgtgatttaggtgtaacgcttgagaatgcgctgggaaatatggcgacgagtgtgaaagatgctgcaataaaaaatctgaatcatttttcaggtagtcagcagacagcaaatcagagaagaactgtttcaccggaaagacaaagacaagagcagaatatgcggggatataaaaagaaactggtgaaagaagccagagaaaaattcgccctgtatgtcaatacttcaactccgagagcacttggaattttatttacgacacttggaattgcacttgtgggaatgtttggagtgacggctgcaacgcttgggattgcaggaatctttattgacgcagttgcaaataagatgcaaagaggaatgtttgtatttatagctgcgatagtggcaagtggagcgcttggcatttatggaaatacgcttcgtaaaaaagtgaatcgcttccgttcttatgtacggactttaaatggaaagacttatgttaaaattgaggagcttgcaaaaggcgtaagaaaatctccaaaatttgtaaaacgggatttgaagaaaatgattaaaaaccgtatgttcttagaagggcatctggatgaagagggaaattatctgattaccagtgatgagtcttatgaacagtatatgcagacaaagaaagcatctgagattcaggaaagagagatgcaggaaaaagaacaggcagaacagaaactgcggggaactctttcagaagaagtgcaggaagtcatcaaagaaggggaagcttacttagaagaaattcgaagctgcaatgaagcaattccgggtgtggaaatttccaataaaatgtatcatctggagaatgtgattttaagaatcttcaagcgggtggaacagcatccggagctgatttcggacctgcataaatttatggattattatcttccgacgaccgttaaattgttgaaagcttatgaagaactcgacaaacagccggttgaaggagagaatattaaaacagcgaaacaggaaattgaaaatacactggatacgatcaatgaagcatttgaaaatcttctggacagcttttttagaaatacggcatgggatgtatcgactgatatttctgttttaaagaccatgctggcacaggaaggactgacaggaaataaggactttgaaagtgtatccggaaaggaaaactaaatgagcgatgaatttaaagaatttgatgtgacaccgacacttacttttggggtggaagaagaaaaacctgtcccgaaagaaccggaaaaaccgacggatccaaatatgactgaagacgtattgtcggcggaagaacgccagatggtggaaagtttttccaagcagattgatatccgcaattctgctgcaatcttgcagtacggagtgggaacgcagaaaaaaatggcagatttttcagaagaagcactcgcaaaagtaacaacaaaagaccttggagaagttggtgatttgcttgaaaatgttgtgaaagaactgaagagttttgatgcggtggaagaagaaaaaggtctgtttggaatctttaaacgtggcacgaataaaattcaggcattaaaaacgaagtatgccaaagcagaaggaaatatcgaacagattgtgcagacactggaaaaacatcagattcagcttttaaaggattcagcgactatggataaaatgtatgcactgaatttgaattattttaaggaactttccatgtatatcttagcaggaaagaagaagctgcaagaagtgcgagaaggtgagttaaaagaactgactttaaaagcacagatgagcaatctgccggaagatgcacaggcggcaaaagatctggattcaatgtgccagcggtttgaaaagaagattcatgacttggaattaacccgtatgatttcgattcagacggcaccgcagattcgtctggtgcagggaaatgataccttaatggcggagaagattcagtctacgcttgtcaacacgattccactctggaagagtcagatggtactggcacttggagtggcacatgcatctcaggcagcaaaggcacaaagagaagtcaccgatatgacgaatgccctgcttcgcaaaaatgcagagacattgaagatggcaaccattgatgcggcaaaagagtctgagcgtggaattgtggatatcgaaacattaaaacatacaaatgagaatttaatcagcacctttgatgaaattatgaatatccagaaagagggtcatcagcagagaatggaagcagaagctgagatgaaccgcttagaagaagaattaaagaaaaaactattggaaatcaatcattaatttttggaggcgaaggtagatgtatcgtgacaatacaaaagtagtttcaattggagacagaaaaatcggtggtggaaatccgattttaattcagtccatgacaaataccaagacagaagatgtcgaggcgaccgtagcgcagattttggagttagaagcagcaggatgtgagattgtccgctgtaccgttccgactttagaagcagcaaaggcattaaaagaaattaaaaaacagattcatattccactggttgcggatattcattttgattataaaatggcaattgcagcgatggaaaacggagccgataaaatccgaattaacccgggaaatatcggaagttcggaaaagattaaagccgttgtagatactgcgaaagccagaaatattccaattcgtgtcggtgtcaattccggttcactcgaaaaagaactggttgaaaaataccatggagtcacagcagaaggactggtagaaagtgcacttgataaagtgcgaattatcgaggactttggttatgacaatttagtaatcagtatcaaatcttcggatgttatgatgtgcgtaaaggcgcatgaactgctggcaaaacagaccaattatccactgcatgtcggaattacagaagccggtactttatactccggaaatatcaaatccgcagtcggacttggaattattttatatgaaggaatcggagataccattcgtgtttctctgacaggagatccggttgaggaaatcaaatctgcaaaaagaattttaaagaccttaaatttaagaaaaggcggaattgaagtcgtatcatgtccaacctgtggacgtacccagattgatttgattggtctggcaaacaaggttgagacgatggttcagcagtttgatttagatatcaaagtggcagtaatgggttgtgtggtaaatggtcctggcgaggcgaaagaagcagaccttggaatcgcaggaggaaaaggtgtgggtcttttgattaaaaaaggagaaatcgtaaggaaagtgccggaagctgaattgcttgataccttaagagaagaactggaacactgggcgaaataatccgttcctatttataataagcaaatgatgagaacttgtattggatggaatagaagaaaggaagcatatcaatggaaaaagatttcttagaagtcttttcaggtcttgaagtagaaaaagaattaaaggcacttttagaagatgtgaaagtgacgaagattgcagtcaatccgaaaaaagaccgtatgagagtttacattcagagcatacagtggattcagaaaaaatacatctatgctctggaaaagcagataaagaaacagttttttgcttcagcgcagatacagataaaaattattgaaaaatttacgctgacctctcagtatacgccaaagcttttctttgaagcctaccgctcttctatgttagatgaactaagagggcacagtattttaatttataatacctttcgtactgcgaaaattgaatttccggaagaaaacaaaatgaaacttgtcatgcagtcctctgtactggcaaaaagtcatgaggaagaattgatttcttatattgaaaaaatcttctgtgaaagatgtgcattctctctgattgtagagccggaatatgaagaagcaggcgaaagtaagatacgcaaaaacagcgaaatacgaattatgcaggaggctgctcatgtcattgagcagtcttctttcgggcatgtaaaagatgaggccgaagagggcacagaaagcgaagcaaatcagccatacacaacaaaagaagagaaaaaagaaagcaagaaagaaagcaagaaagaaaacaaaaaagaaaaacagacggaatcaaaaacgaaaaaagaaaatacaaaagaaaaaagatttacgcaaaactccgaatacagacgtggcgtgaaacgttccgataatccggatgtgatttatggaagagattttgatgatgaggtcattccgttaagttcggttcagacagagatgggtgaggtctgcatccgtggacagattatgagtttggatacccgtgccatccgtggtgaaaaaacaattattatgtttgcgattacggattttacggattcgattatgataaagctgtttgccaaaaatgaacacgtagatgaaatcttagagggcgtaaaagttaaaaactttattaaattaaaaggtgtcaccaacattgaccgtttcgacagcgagcttacgattgcgtctgttgccggaatcaagaaaattgcaccatttacttcttcgagaatggataccagtccggaaaaacgagtggaacttcactgtcataccaagatgagtgatatggatggggtttccgatgcaaaacagattatcaaacaggcgtatgaatggggacataaagcgattgcaattaccgaccacggggttgttcaggcgttcccggaggcaaaccactgctttgatgagtggggcggagttgtgccaaaagatgcggattttaaagtcatttatggaatggaagcctatctggtcgatgatttgaaaggaattgtacaaaacagtaagggacaaccgcttagaggaaaatacgtggtctttgatattgaaaccaccggattttcggcaatggcagataagattattgaaatcggtgcggttcgtgtggaaaacggaatcatcaccggacgtttttctgagtttgtaaatccgaagattccgattccatttcggattgaaaagctgaccagcatcaatgacagtatggtggcaggggcagaaaccattgataccttgcttccaaagtttattgaattttgcgagggcgcagttatggttgcccacaatgcggaatttgatatgagttttattcagaaaaactgtaatgatttaggaattgagacagactttactttcgtagataccgtgggaatggcgagattcttactgccacagttaaatcgttttaaacttgacaccgtagcaaaagcggttggagtttctctggaccatcatcaccgtgcggttgatgatgcagaatgtaccgccggaattttcctgcgctttatcgagatgtgtaaggaaagagatattgaaaatctggatgatttgaatgaaaaaggagcagtttctgtcaatgccatccagaaaatgccgacctatcatgccattattctggcaaccaatgatatcggacgtgtcaacctctatcatctggtatcggattcgcatttgatttattatcacaggcggccgagagttccaaaaagcgtgtatctaaaatatcaggaaggcttactgattggttccgcctgtgaagccggagaattgtatcaggcagtgttaaacggcagaccggagccggaaattgcaagactggtaaatttctatgattatctcgaaatccagccggtcggaaacaatgaatttatgattcgtgatgaggatcgtggcgatatcaacagcgaagacgacctgcgtgaaatcaatcgaaagattgtaaaactaggagaattatttaataaaccggtcgttgcaacctgtgatgtacactttttagacccggaggatgaaatctaccgccgaataatcatggcaggaaagggatttgatgatgcagatatgcagccaccgctttacctgcatactactgaggaaatgcttcaggaattttcctatctgggaagcgaaaaagccgaagaagttgtaattaccaatccaaataagattgcagatatggtagaaaagatttctccgattcataaaggaaaatgtccgcctgttatcgaaaattccgatgggatgcttcgagaaatctgttataacaaggcgcatgaaatttatggcgatactcttcctgaagtggtagaagaacgcctggacagggaattaaattccattatttccaatggatatgcggttatgtatatgattgcacagaagctggtgtggaagagtaacagcgatggttatctggtaggttcaagaggttcggttggttcttcttttgcggcaacgatgtctggaattaccgaagtaaatccattaagtccgcattattactgttcttcctgtcattatagcgattttgattcggaggatgtaaaggcttactcaggacgtgccggatgtgacatgccggataagatctgtccggtctgcggaaaaccattaattaaggaaggatttgatatcccatttgagaccttccttggatttaaaggggataaagagccggatattgacttgaacttctcaggagattatcagggaaaggcgcaccgctacgttgaggttatctttggagcaggacagacattcaaagccggaacgattggaacacttgcagagaaaactgcatttggttatgtgaaaaattattttgaagagcgcggagaccgcaaacgaaactgcgaaatcacaagaattgtacagggatgtaccggagtcagacgaacgacaggtcagcaccctggaggaatcattgtacttccgattggctgggatatcgaagaatttacaccggttcagcatccggcaaatgatatgacaagtgatattattacgacgcattttgattatcactccatcgactcaaacttattaaaactggatatactcggacacgatgatccgaccatgattcgtatgcttgaggacttgaccggaatcaatgcaagagagattccgctggacagcaaagaagttatgtcattatttaaaagtacggatgcacttggcattacatcggaagatatcagaggttgtccgcttggctgtcttggaatcccggagtttggaaccgactttgcgatgcagatgttaattgacgcaaacccgacttccttttcagatttggtgcgtatttctggtctgtctcatggtacagacgtatggcttggaaatgcgcaggatttgattaaatcgggtactgcgaccattactacctgtatctgtacccgagatgatatcatgatttatctgatcaataaggggctggaacatggacaggcatttaccattatggaaagtgtacgaaaaggaaaaggtttaaaaccggactggatagaagaaatgaagtcacacggagtgccggactggtatattgaatcctgtaagaaaatcaagtacatgttcccgaaagcacatgcggcagcctacgttatgatgggatggcgaattgcatactgtaaaatatattatccactggcatattatgcggcatatttcagtatccgtgcgaccgcattttcttatgaactgatgtgtcagggaaaagaaaaactggaatattttatggatgattatgaaaagcgaaaagatactttaagtaaaaaagagcaggatacgcagaaagatatgaagattgttcaggaaatgtatgccagaggatttgaatttgtgccgattgatttatataaggcaaatgcgcatacgttccagattatagatggaaaattgatgccggctcttgatacgattgaaggacttggagaccgtgccgcagatgcggttgtgctggcagcggaagatggagcatttttatcaaaagatgactttagaaatcgtacgaaagtcagcaagacggtaattgagttaatgtcggatttgggactgttcggagatttaccggaatccaatcagatgtcgttgtttgattttcagtaaaaaatattaaaacgagtaagtaaagaaaaaaggaagacaaaggttatgaattatcaggaagcaagagcatttttagatgaagtaggaaaaagcggaagcgtgcttggactggaaggaatgaaagaactattaagacgtctggataatccgcaggacaagctgaaatttattcatatttctggaacaaatggaaagggctcagagctggcatttctttcagaaattttgacaaaaagtggataccgtaccggaagatacatttctccgacgctgtattcttatcgtgaacgcatccaggtagataaagaaatgatagaccgtgattctctggcaaaacttacgacaaaagtaaaagaggcagtggacgggatgctttcagatggattacagagtccgaccgtctttgaagtagaaacagcgatttcatttttatattttgtagaaaagcagtgcgatatcgttgtattagaaaccggactgggcggaacactggatgcgacaaatgtggtaacaacaaccgtgctcgaagtgattgcttcgattggaatggatcatatgatgttccttggaaatacgcttggagagattgcaaaaaataaagccggaattattaaaccgaatacagttgtggtatcggcaaaacaggagccggaagcagaagaggttgtaaagaaagtcagcgaggaaaaacatgcaacgctctcgattgtaaatccggaggaaatcaaagacgttcattatggatatgaaacacaacgcttttcttataaaaactggaaagacatcgaaatttctcttgcaggaacgtatcagataaaaaatgcagcacttgcactcgaagcagtggagacacttcgaagtcttggctatcagttaagtgaagaaacggtacgaaaaggaatgaaagaagcgacatggagaggacgcttctctgtcattcataaagacccggtggtagtcattgacggagcacataatccggcagcggcaactgtcttaaaagaatccttagaaacttattttaaaggaaaaaacctgtattacatctttggggtatttgcggataaagactatgaaaaagtcattgaactgactgcgccgcttgcaaaacagattgtgacggtgcagacaccaaataatccaagagcactgccggcagaagaactgaaaaaagcagtagaaaaagtgaatccgaatgtaaaagcggcaaaaagtgtggcagaagcagtggaagaagtaaaagcaatgacgacaaaagatgatgtagtgattgtatttgggtcactttcttttttgagtttggcggatgaggcatggaatcggtagataaattttgaaaaaaatatttggctaaactgtttgaaaattaaatctataattgttatagaggagattaaaaaatgtataaagtaaaattttttagtggatatgaagggaaaaattttattgggttaagtccagaagaagtaataaaaaatatgtccgattttgaggaaacgttttatggtgggaagaataaagaaattcgacgagatatttcaaaagatattatagcgtattatgacaagaaaaataaaatttgtgaagcaatacagtttgtaaacgagcatacagatatatatgttaatggagttcagcttatgcgtgttccagaagaagaggttattccaacattaagaaaagtttttccaggagaagaagggtttaccgatggttcaaattatatgtatatgaaatatgcatttagtgtgtttgtgacagaggggcaggtatatggagtaactgtggggaagaaaaactattttgatttttggaaagaagatttagaagacttaggtcattctggattaatgaaattttaagagaagagagattgaaatatgaaaaaaatagttaaaatcatacttcctgttgttatcgtagcagcgggatttggaatgttcaagtattcgcagaaatccctccaatctgaatcagcaaaggaacaaaaagaagcatcaaaggaaacgtcaaaagaatcagaacaaacagatgaggatgaaaagacaagtcaggactatgaaggaatccaatatgatgaagatggtttcatgatgagtccggatgaattaaatgcagaccttccagaatcgacttatgaagagatagaggcagacggagcatatgaagaagcgatggatgcagaacaggaagaagaagagaatgaaattcatttcgatgatggaacggcaacggatatctcagattctgttacaatagagtcctatccggaatacagttcagatatcagtagtgattcggatttatcaggcgagaatcctgcttcttttttcatgagcggagaatagaaagggtcaattgtatacaatttatggtttttctggaaaatttgaataaaatttcataaaaatcactaataaacctagctaaaaaagcaattttgtggtacatttaataagtaagtatttagaggcttatttacctgattcttttcgttcttttttgttgcggagctgaaaggaacgaatcgaatcagatatcataagggattatttattttcattatcaaaaaaatataaggaaggtgagcaattggaaaactatactaagtataagctgaaaagtaatgatgagcttgcatcagtgcttgaaggcaaggacaatctgtttgtgattgcatgtaacaagtgtttcaaagaatttgaaactgttgacgaaccagattgcgatgagtttttaaaatttgctgcagagcaggggaaaaatgtcacaggcagtgcaaaattagacttcttatgcaataagatgcacacagaaaacaaattacaggatttgattccggagggaacagaaaatgtagttgttatttcctgtggtcttggtattcagaccgttgcagatttagcgggcaaaccggttattgctgcaagtaataccttaaattacagaggtcaccatggtatggcacttaccaagaagagctgtgacgcatgtgcacagtgttatctgaatgttacaggtggtgtctgtccgatcgtcgattgttccaagagtcttgttaatggacagtgcggtggagcaaaaaatggaaaatgtgaagtagacccgaataaagactgtgcatgggaaaaaatctaccagagactggcaaaacagggtcgtctggaagaatttttaaatcagccggtacaggttcgtgatttctcaaaagtaaatttcaaagtcattaatgattatgtaaaatcaatcagagatgaaagactcaatggatattatggtggtgttcatccgtcagaacgtaaagagttcagtgaacatattgcacttaagaaattcccggaaccaaaaacggttgtaatctctatgtcccagcaccttggagcaccggcaaatccaatcgttgaagtgggcgataccgtaaaggtaggtcagaagattggagaagcagcaggctttatcagtgctccggtacattccagcgtaagcggaaccgtagttgctgttgaacctcgtatgcatggcacaagaggcagtgaagtaatggctgttgttattgaatcggatggaaaaaatactctgcacgaatccgtacagccacatggtgatttagataatcttacaccggatgaaatcattgatatcattcgtgaagcaggtattgttggtatgggtggtgcaggtttcccgacttgcgtaaaattaaaaccggcaaaaccggttgataccattcttttaaatggatgcgaatgtgaaccgctcttaacagccgaccacagagtactccttgagtttgccgatgacattatttttggtttaaaagcaatccttaagacaacaggtgccgaaaaaggtatcatagttatcgaggataataaaccggatgccattgaattaatgcaggaaaaagttgccaatatcggaaatatggaagtgtttgttgcgagaacgaaatacccacagggtgcagaaaaaactctgattaaacgtgttatgggaagaaaagttccaagcggcggtcttccggcagatgttggtgttgtagtagataatatcagtacagtaaaagcaatctccgatgcaatccagacaggtatgccactcgttgaacgtgttgcaactgtaactggtgaaaagattaaaaatcctggcaactttatcatcaaaatcggtaccagcgtaagagaactgatcgattactgtggtggatttacagatgatgatgttctggttaagatgggtggtcctatgatgggattcccacagagtacattggatgtaccgatgatgaaaggttccaatggtattattgcaattgatacagatgagacaaaagaacagccatgtatcaaatgtggacgctgtgttgatgtttgtccgatggaactgtctccattgtattttgtaaaatatgccaaagaagagaactggcagggcatgaaagatatgaatgttatggattgtgtagaatgtagatgctgccagtatatctgttcttctaagattccgattattgacagtatcaaagccggaaaaaatgcgataagggggatgaagtaatatgttaattacccagttaaaagcaaaagaaacaattacatcattgacagccggaaaaaaagtttttatcatcaactgccatggatgtaaggaagttcgttttccggaaaaagaagctgttgaacttcagaaagaacttgccgctgaaggaaatgtaacaggtgttctcacaactgattatatttgcaatccggaaaatatggagttacgtctcaaaaaacatttaagtaaaattcaggaagcagacttagttttagtattttcttgcggtgttggtgtacagaccgtagcagaatatcttgaagataagatggtctgtgcagcttgcgatacatatccggtacctggtttccagggcgtgacaccgttagagtacaaatgtgaccagtgcggtgaatgttacctgaatctgacaggtggaatctgtccaatcacagcatgttccaagagccttgtaaatggccagtgtggcggttccaagaatggaaaatgtgaagtggacagtgagatggaatgtggatgggaacgcatttacagacgtttgaaagaaatcggacgccttgatgtattaaaatgcccgacacaggttcataacttcgcaacagacgatgaagtaaaatagtgaaaaaagaagcttaattaagctatgatattataatgattggagcaatgtacaatgaaaatgaaagaattattcgaccgtggtgaatttgtagtttctgctgaagtaggaccgccaaaagggattcatgtagatgagctgttagaagaagcaaaaacataccttcagggtgttcatgcagtaaacgtaactgataaccagtcttctgttatgcgtcttggttctcttgcaatgtgtaaagcattaaaagatgcaggcatgaatccgattttccagctggcatgccgtgacagaaaccgtattgcactggaatctgaccttctcagtgctgcaatgtttggtatcgaaaacatcctctgtctgactggtgaccatacaaaaatgggtgaccatccgcaggcaaaaccggtatttgacttagactctgtatcccttcttcacacagttggactcttagagtcaggtgtagaccttggtggaaatgaattagttggcgaacctccgaaattctcaaaaggtgcagttgtatctccatgcagcgattctgttgatgcacagcttgctaaaatggaaagaaaagtagctgcaggtgcagaatacttccagacacaggcaatctttgagccggaaaaattcatcaaatttatggaaaaagcaaaacagttcggaaaaccggtacaggttggtatcatcattccgaaatctgcgggaatggcaaaattcatgaacaataatgttgccggtattcatgttccggatgaaatgatcgaagaattaaaagcagataaagaaaagacaaaagctggtattacaggtgttgaaattgcagcacgtattatcaaagaatgtaaaccatactgtcagggtgtacatatcatggcacttggctgggaatctaaagttccggaactgctgaaacaggctgaaatctaaaaataataaatttaagaagaataataatagagggagcagcgcacaagttagtgcgtagctccctcttagtttaagcaagcagttctttcatcgcttctaataattcggtatttttttcagggctcatcagacagaaccggatataactgttatctaaaaacgggaaagtggaacagtcacgaatcatcaatccctttttgatgcagtggtcaaacatcatttcggaagtgacttcttcttttaaaatttttacaagaataaaattcgtacaggacggatagactttgacggtatccagtttggacaattcatttgtcatgcgttctcgttctgtggtaattaaagtctttgttttttcaatatattctttatcggaaaacatgatacagccggcaatttctgccagactattgatagtccagggattctttttggtgttaatatgttttaacaaatccggatttccggttacggcatagccaaggcgaagccccggagctgcaaaaaatttggaaattccgcgaagcacaatcagattggtataattgttagtcagcggaatggaggacatattcgctgcgtccggagcaaattcttcgtaagtttcatcgaccatgacaaacattccgtactggagtgcagtatccaaaatttttctcatttcttttttggtaatggcagaagcagtcggattgttcggattgcacagcacaagtaaatcaatcgaatcatttagctggtggcagaaatcatcgacgttcatctggaaatcattttcttcttttaatggataatataaggtatgtccgccctctaaggtgatttcacgctcatattccgaataagtcggtcctaaaatcagggctttttttggatgagtggattgaataaataaagaaatcaattcagtagatccgtttccaacaataatattttcaaactgcgcaccggtataatcacagatactttttctcagttttgtatagtcgcggtcgggataagaagtgatagcgtctacatgcctggaaagagtatcccttaaaagaggggaaattccaagtggatttacattggcagaaaaactggtaatatcctcttttttgattccgtaaatatcctctattttttctaaatcactgccatgaaaatggtctttatgtttcagcatatcgtagatgctcctttcttttttacgtgtcatgcaacttgtctgatgcagtctttcgagaggttgcgtctgttgcatttgtagtgtataattcacattatagccagaaaataaaaattgttcaatataaaataagcaacgggaaaaaaagagaaacaacggggtaaatacattgaagagaagaatggagcagttaataaacggaagatttgaatatgaagtgccaaaactcctgttttcacaaaacagcattgcggtaagtacaaagccggaagaaaatgtaaggggagagctggttattcgggcagaagataagagccgtatcaaaggacttgtatactcttctcaccgcagatttcttcttggaaaagagcgttttttaggacaaaatgtgacgattccttatggcgcagatgtgaatggattaaagccaggagattcctttgagggagaggtggtactgactacaaatgtaggagagtatcgtctgccatttcagatttcaatcgaaaaagaagaagtaaagacagctatgggtgcaatcgacaatttggatgcatttacacagcttgcaaaagaagatttcagggaggcatatcatttatttgtagatgcctctttccggacccttttaaaagattgtcaggaattgcttccctattattttgcaatgacgacaaaaccggttacactacagaatctggaagagtttttaattggaattggaaaaaaagagcgggttgccctgaaaatcgaatcggaaaatctggaagtttatgaagtaatggcttctttaaaagatactcttcggattcatagaagcacctggggacatttaaaagcagaaatctttgtagaaggggattttctggaagtagagaagaaaaaaatcagtgatgatgatttcatcggcagtgtttatgagatggaatatattatccgcagagaaaatcttggaaaagggaaaaatttcggacggattcgtatcaggacggtgtatgaagaactggtttatacggtgatggcgtcaaagtcaggagaaagacaattagaccttgagacttatgcaaagcataaaaaagtagaactgttgcgggactttctggatttcttacttggaaagacagaattttcgttctggaagggacagacggaagccgcattttcagaagcacaggagaatggatttttcacgactgagtacaaactggtacaaatttatctgttacactgcttaaatgagaaggaacaggcaggaaaactgcttggtcagttaaagtctgaaaaagaagtgatgaagaataaacgtctgtccggaatttgcgagtatttggaatatgtgctggatgacaataaagaagcatttgaaacttctgcaaaggaaatgcagtttttggagaaacagtacaatgagggcagcaggagtccatttttatatcttcaggcatgccgtcttgccgagaaagatggggcactgcttcgcagatttggtggatttacaagacaggttatgctgtttgcaaaacgtcatggaatcctttcagaagagatggcatttcgtgcaacagatttatcggaaaaccttcgagagtattcggaatctgtctatgagctgctggaatatatttatcagagatatccgtccgcccaggttgtgcgtgcaatttgccttttgattatgaaaggaaaagcgggagaagaacggtatttcaaatggtatgaacttgcagtgcagaaagatttgaaaatcacaagactctacgaatgttatatcgagacgatgagccggaattatcgtggaatgttgccgagaatgatccggatgtattttggatacaacaataccctgagtgataccaaaaaagcttttgtatacagcaatgttatccgcaataaaattcttgataaggtaacctatcaaagttatcgggcaacgatggaacagtttgcacaggataaattaaaagagggacgcatcaatgaagattttgcggtgatgtatcgtgaattttgtctgaacagtaaggatgaagtaatcaaacgggcacttggaaaagtattgtttgtacatcgtttgtactgtgatgatccgaaaattcgaaaagtgattgtgaaacactctgcgtttgaaaaagagcaggtttatacgtttaacaatcatgcagcatatctttctatctatacaccggatgcaggaattgtatttgaggacgactgccagagaagatatattcagaacgtggattataatcttcagccgttatttgagcgggaagagctggcgagagaacttgcaaaggaagaacatcagagcgcaggactgcttttatatacgtgtggagaacttgcacatgaaaatcagattacactgacgaatcttcacagttttgagcttgcagccgaggaagaaagcttttcaaaagaatacagacagcagattcgcaaacgtttattgttgttttatcaggaatacatgggagaagaaaatttgaaggcttctctggaaaaaattgattttcagagttttgcaaaaatcaataagagccttttgattacaattctgattaaacagaaaatgtatgtgggtgcttatgatttaatctgtgaatatggatatgaagaaatcaatttcgtggatttactgcacttgtgcacctgtatgattcaaaatctggattttgaatatgaagaggaattagtgcttctggcgcatgacatttttgaacagggaatttatgatgaagttatcttgaagtatctggtaaaatactttaaaggtccggttgataaaatgatagaaatctggcaaagagcaatgggattttctttggatgcttatgagctggaagaagatatcttgattttcagtatgtttggacgaatctggacacctcagggctcggcggtattaaaagattatgtcagacagcgtggaaaagaagtggtaattcttgcttatgttacctttgaatcctttgaatttctgcttgccggcaaagaatcagaccgttttgtgttccgttcgattgaacaaatccgcaaacgtgaatgggaacatgactcgatttgcgatgtggcattgttaaaatcttatgagctggaacaggactgggatgaaaagcgcatgacaaatgcagaagccattttggaagaatgtgaaaagaagggattaaaatttgctttttatcagaatcttccacgaacgcttttacagaagagccaggaagaagataaagtatttgtagaatgttttgccggaaatgatgcaaaagttacgctgtattaccggattcgtgagaatagtcaggaagaaactccatataaagaagaaatgttggcaaaccgctatcatggaatttttaacaaagaatttctcttattctgtcaggaaaccttggagtattatttcgtaatcgaaaaagagaaaaaagagtatacaaccgaaacagaagaattaaccgtatccggtgaaaagaaaaaagaaacaacaaaatatcagatgataaatcagatgttgtcagcaaaacagcatggaaaagaagaggaattaaaagatgtgcttgaaacatacaggcaaagagaagcctggattgcatcacttttccgattgatggaatagcagagggagacgaggaatgaacgagacaagaaatatcattgcaagtctggaatttggagaaaaagaatctcagatttgttattatgacagaaaagaaaaaaatccggtttctcttgcggtaaagaccggaacgacggaatatacctttccgacaagattgtccaaacgtcccaaaacaaatatctggcattttggagcggaatccgaatatttttcgaaatatgagggagagatactggtagaggatgtactgaatctctgcatgaaaggagagccggttgagattgacggagaagtccatgaggtagaagaactgcttgaagtattcttaaagggctgtctttctatgcttggagtgggagaaccgcaaagacagattaaaattttaatgattacaacgccaaatctgaatcgggtatttatccgtaaactgcagaaggtgtgcagacatttgaattttgcaaatggtcaggtactgatacaggattataatgagagtttttattattatgcaatgcgtacccgccatgataatgcaaaccgaagtacaggcttattctgctttgataaaaacagagtgcattttcgaaaactctggattgatacgacaacaaaaccgatgattgcaagagttgaagtgggaaaatccgaattgctttcggaaaatccgaaaaaacgggataagagattcgctgaaatgattgaaaaatgctgtggagaggaaagttattcaaatctgtatctgattggcgaaggatttgataaggaatgggcagtagattctcttaccgccctttgtaaaaatcagagaagagtttattacggaaataacctgtatgtacggggagcttgctttgccgcactggaaaaaagtgaggataagactcttggaaattacctgtatgtgggagaagctttagtaaaaaatcatattacaatgaatatgaacattcagggaaaagaccagatttataccgtaacagaaggtggaaaaaactggtacgaaacggaacatacttttgaactgattttagatgaaaaagaagatttggaatttaccttacagcctatggatggagaaaagccttttgtgcacacaatgaagttaaaaggacttccgaaacgtccgaagaaagcgaccagattacggatacaggcagtttatgaatcagcagattgctgtgtggtatttgtggaggatttgggatttggagaacttttcccatcaagcggtttaaaatggaccgaaaaaataagatggcaggaggcagaacatgagtgattatattttatgtcaggtaaaaagggcttcgctgccgttttatgtggaaaacatcagtaaaaatatttatagcatagaagaactctgttattatttttataaaaatatttatctgattgatgaaagtattatcaatgaacggctctgcaactggctgaaagatgagttgggactgtcaaaattatatgaaaagctgtaccggattttggaaaaagaagagggaacgagtgcatttattctggcaattttccgtgagattcattatctttcccatgaagaatttaagaaattaaatgaaacccttgaaattttagaaaagcagcttccggcagtgcgaatcaagaaaaaaggcgattatcttgtcagcaaccggatgtatgtcaatgcaatccgaatgtatgaaaatgctctggtatccgcaaaaagagaggaaaatcttggacttcagtttgaaggtgaaatttataacaacatggcttatgcgtatctggaactgtttcagatggaagaggcagcaaaatattttaagaaagcttatgaaaaattgccgactcagcagattcgcagacagtatttctatacctgccgtatgtttatggatgagggaaaatggagagaagaatgtgaaagcatgggagcggatgagaaagagcgaaaagaacttgtctatgaaatgagtcaggtcaaaccagagcagatggcgtggaatacagaagaaattgatgagatgctttctgattttaagaaagaatatcatagaagtacagggttttagcttgtgttttcttgctacgtgagctataatccaaaaagtaagaatacttgtaaaaacgaaaaaaggagattagaaaatgagtacagacagatatcagagtccattatctgaacgttatgcaagcaaggagatgcagtatattttctcaccggatatgaaattccgtacctggagaaaattatggattgcacttgcagagacagaaaaagaactgggattaaatatcacacaggaacagattgatgagctgaaagcacatgccgatgatattaattatgatgttgcaaaggctcgtgaaaaagaagtacgtcatgatgttatgtctcatgtttatgcatatggtgtgcagtgtccaaaagcaaaaggaatcattcatcttggagcaacatcctgttacgtaggagacaacacagatattattgtaatgacagaagcgctcaaactggtgaaaaagaaactggtgaacgtaattgcagaacttgcaaaatttgcagatgccaacaaagcattgccaactctggcatttactcattttcagccggcacagccaacaaccgttggtaagagagcaactttatggatgcaggaatttttaatggatttagaagacttagagtatgttcttagcaccatgaaactccttggttcaaaaggtacaaccggtacacaggcaagtttccttgaactgtttgacggagaccaggagaccatcgataagattgacccgatgattgcgaagaaaatgggatttgaaaaatgttatccggtatccggacagacttattccagaaaagtagatacaagagtattaaatatcctggcaggaatcgcagcaagtgcacataagttctcaaatgacattcgtctgcttcagcatttaaaagaagtagaagaaccatttgaaaagagccagattggttcctcggcaatggcgtataagagaaatccgatgagaagtgagagaattgcttctttatcccgtttcgttatggtcgatgcgatgaatccggcaattacatccgctacacagtggtttgagagaaccttagatgactctgcaaacaaacgtctttctgttccggaaggcttccttgcaattgatggaatccttgatttatgcttaaacgtagtagacggactggttgtatatccaaaagtaattgaaaaacgtttaagaagcgagcttccgtttatggcaacagaaaatattatgatggatgcggtaaaagcaggcggagaccgtcaggaattacatgaaagaatccgtgaactttccatggaagcaggaaagaatgttaaagtagaaggaaaagaaaataatctgcttgaactgattgctgctgaaccagcatttaacatgacattagaggatttacagaaaacaatggagccatccaaatataccggaagagccgaagtacaggttaatgcatttttgaaaaatgtagtacagccggttcttgatgacaacaaagaaattcttggtatgacagcagaaattaatgtttaaattaatattttgataagaaagacaagaggggtcttataggtaacttttacttataagacgccccttttttggaaaaaaacactaaaaataaaaaaaacaatgctttttttaaaatagaactttatttctcaaaagaaatgtagtatgatacatgagtacaaataagcacttttaggaggaatgcaaaatggtaaaagcagtagtaggggctaactggggagatgaagggaaaggtaaaattaccgatatgctggctcaggaatccgatattatcgtaagattccagggtggtgccaatgctggccatacaattgtaaacaattacggaaagtttgcacttcatactcttccgtcaggtgtgttttatgaccacaccaccagcgtcatcggtaacggtgtagcgcttaacatcccagtactgtttaaagagattcagtcaattgtggaaaagggtgttccgatgccgaagattaaagtatctgaccgtgcacagatggtaatgtcctatcacatcaaatttgatgagtatgaggaagaacgtctggcaggaaaatcttttggttctacaaagtcaggaatcgcgccgttttattcagataaatatgcaaaaataggttttcaggtaagtgagctttttgaagatgaagcagtactcagggaaaaagtagaacgtgtctgtgtaacaaaaaacgtacttcttgagaatctgtatcataaaccggctttaaaccctgatgatatcatggaagaattaaaacagtacaaagaaatgatagcaccttatgtgtgtgatgtttctttatacctttggaattcattaaaagaaggaaaagaaattcttttagagggacagttaggttcattaaaagacccagaccatggaatttatccgatggttacttcctcttctacactcgcagcttacggtgcagtaggagcaggtatcccgccttatgaaatcaaaaaaattattacagtctgcaaagcatattccagtgcagtaggagcaggcgcatttgtatctgaaatcttcggagatgaggcagatgaattaagaagacgcggcggtgatggcggagaatttggtgctacaacaggacgtccaagacgtatgggatggtttgactgtgtagcttctaaatacggatgccgtatgcagggaacaacagacgtagcatttacagttttagatgtacttggataccttgatgagattccggtttgcgtagcttacgatattgatggagaaatcacaacagaattcccgacaaccgcattacttgaaaaagcaaaaccggtaatcgaaacattaccaggctggaaatgcgatattcgtggaattaaaaactacgaagaccttccggaaaattgtagaaaatacattgaatttgtggaagaaaagattggattcccgattacaatggtttctaacggaccgagcagagatgatattatttacagaaataaataagatttaattaaaaacaggacagaggacccctaagtcgttacgaaagaatgactcaggggtttttgtctggaaaagtaaaaacaaagtagagtataggagatttaagtttatgaaatatgatgtaattattattggtgcaggtccgggtgggattttctctgcttatgaactgcttgagcagaataaagacttaaaaattgcagtatttgaagcaggtgcaccgcttgaaaaacgccgctgtccgattgatggtgataaagtaaaaacctgtattaaatgtaaaacgtgtgcaattatgagtggatttggaggagcaggtgcattttctgatggaaaatataacatcacaaatgatttcggtggtactctctacgaacacattggaaagaaaaaatcactggaattaatgcattacgtggatgatttgaatgtaaaattcggtggcggagaaacaaagatgtattctactgcaggaacaaaattcaaaaaactttgtctgcaaaataaattaaacctgttagatgcatcggtacgtcacttaggaacagatatcaactatatcgtactggagaacatttatcaggaattaaaagacaaagtagaattccgtttcttctatccggtcagccgtctggaaatgttagaagatggatatcgtgtgttccacgaagaagaatatgatgactgtgataaatgtatcgtttctgttggacgaagcggaagtaagtggatggaatctgtctgtaaagaccttgagattccgacaaaatcaaatcgtgtagacttaggtgtccgtgtagaacttccggcagttatcttctctcatctgactgacgaactttacgagagcaagatcgtataccgtacagaaaaatttgaggataatgtgcgtaccttctgtatgaatccgtacggaatcgttgtaaatgaaaataccaacggaatcgttaccgcaaatggtcacagctatgaagaccctgaaaaacagactgaaaataccaactttgcccttttagtatccaaacatttttctgagccgttcaaagacagtaatggatatggcgaaagtatcgcaagactctccaacatgcttggaggcggtgttatcgtacagcgttttggagacttagtaagaggacgaagaagtaccgtgacacgtgtggaagaaggactggtacgcccgactcttgcagcaacacctggagatttgagccttgtgcttccaaaacgtatcttagatggtattatcgaaatgatttatgcattagataagattgcgccaggtactgcaaatgatgatactctgctttacggtgtagaagtaaaattctataacatggaagtcgatattgatgaaaatctggaaaccaaatataaaggtctgtatgtgattggagatggtagtggtgtcactcattctctttcccatgcatccgcaagtggtatctatgttgcaagacatattacagaagaatgaaataaaaatcaggtttcaacaaatatagcaaggattctcccacctctataggtggtgagaaaaattgcaaacaggaaggttaacggcagtggtgggcggagagaaatcggtatcctccattgacatgaggtaaaccacagtcagcgttttgctgacatgtcagactctgtgaaattaccgactgtggattgaaacaagaatatcaagaatactttcttcaaaaacaaattgattttctttacggatttttttataggcagatggcggaagtggagactccgccctgcctatttctattgtcagacttggaatattctgctttaaaagtgcccagtctttatagcctgccgggtcaagttcctcataattgtcatcgggagtatagccggtaatgtcagaaattcttttggcgaaggactgtgttttttttgccagttctccacgctgtccaaatgaccagtaaatcacagcaccggaagagtgataactgatcgtgcggtcaaatttttcttttaacgttaattgaatcaaagtatctgcttctaaggtacatccggctgacggacctttataatgttcacttgccggtttttggactccatcatagtaactttcccagagcgcatcaaagtttcggtttacatcaatgccttctgcattggatttccagtatttaaagtactgtttccatggcatccttgccccttctctgcgtgcaatttcccatactctccttcggttttcctctttgtttagagcatcgggccccatttggctgatagtaacaccatcgggattaaccatgggaaggagaaagagcgaacaggtatcaaaaaaagtctgatacgaatatccacgataagtctgtttttctaaaatggctcttgcaaatgaggcagtcaaatccatgagaagctggcaggtcatatattctcttccgtgaatccccgcaaaaattagaattttgtgtctggcatcgggctttccgattcgtgcctgaaaaatttcccgaccgtcgattgtacgtgcaagagtggtgatttgtacaattttctcaaaaattcttgaataaatatgtaaatcattttttaagtcttgataagaatagccggaaaattgtagaatctgtcgattttctctgacatttcgagcattaatgtccattgacgtaaactcctgaactctttataattaaagatattcaaaaaagggaggtttcagacgtgaagaagctaaaacaattgtttgctcttttagtcgtcatactgcttcttggtttatatgcacttacccttgtatttgctctgatgaaaagccctgcggcacaggatttacttctggcatctttgtacgcaaccgtaattcttccggttcttatctatgccattttgctcgtctataaatggagaaaaccggatgataaaataccaaagattgacgaaaaacatgccaaagtaaataccattatttttgatttgggaaaggttcttgttgattatgactggcaggattatttaaaatccatggcattcgatgatgatgcgattgaggcagttggagatgcgatgtttgccagcgatgactgggtagaagcagatcgtggagtacgcacagaagaagaaattttacagtcttttattgataacgacccggaatatgaaaagcagattcgtgatgcgtttgatgatatgggctttacgattcatgcattttcgtatacaaaaacctggctgaaatacctgaaacgacgaggatataaactttattatctctcgaatttttcaaaacctctctttgaacggtgcacgcaggagatggaatttttaaatctgatggatggcggttatatgtcatgggaagtgcagatgataaaaccggacgcacagttttatcagaaactgttgaaagattttaagattgagccatctaaggcagtatttttggatgacgtgatggaaaatattgcagaagcaagagcacaggggttaaatgcagttcattttacaaataagaaagaagcaattcgtgccttgaaagacgactttggggtagaataacaaaaaagcaatccgaaaactcgggttgcttttttgaatgctatatatgctgtgtttcatttatcgaatggaaaatgcggaagccggagagtaagaaccgccttgctgtctgtcatttgagtttccgtttccgtttgtctggctgttgccgtcagaagaagtatcggatttgcttcctaaagagatggaaacagttttttctttgtagctgtcactgtccggtacttgaagagttaactcaaccgtttcaccggctttataatattgcagcaaatcctgaaggctttcgatatcagtgacggattttccatcgaattttgtgatgacagagccggaagtaatgccggctttttcagctgcgctgccagaagttacttcagatacatagataccttccggaagattatatttctcctgaacatcactggttacattgattcctttgataccgattgttccctgtttgtcagagtctactttggttctggttgtctggttcatcagattatcaatgatatcagaaactctggaaatcgggattgcatagcccataccttctacttctgtggaagcaagtttcgcagagttgataccgatgacttcaccattcatatttaaaagcgcaccaccgctgttacctggattaatagcggcatctgtctgaatataagttgcagaactgctgtcatcagaagaagagttgctgtcctgtgtatcagaagaattattgcttaaagcacgatttacggcacttacaataccggttgtaacggactgaccatatcctaaagcattaccgatggcaacaacctgttcgccgacttttaaagagtcagaatcaccgatggaagcaacagcaatctgagacattgtatcatcggaaatgctgtcaagcggaactgcgataactgcaaggtcattttctgcgtctgtaccttttacgtttgcctcatataccttattgtcgatgaaacaaacggaaagagtatcggcaccttctacaacgtgattatttgttaccattaaaagttctgtatcatttttgccgataataataccagaaccctgactttcggtttcctgagtctgtgtctgaccttggcctctaaatccgaactgactgaagtaatcctggacttcctgaacagatttatttgtgattgctacgatagatggcattgcagatgttgtgatatcagagacatctaaactgcctttattagagctgtcggaagtagtggttgtctttaacagactagcacttgaactattacttttagaagtctggcttgaactgtttgttgtttttgaaacaggtgaaaagtaatttacagcctggaaagaaccggcagcgacagaaccaaataaaacagcacttaaagtgatagcaccgattttctttgcaagttttttagaatttttaggattctttttattgttattatgactgccggatggtgtcagtggctgataagtattggtttcattttccatttcattattattttctgtatgattaaaatcgtaattgtttaacatcatcaattcctccttgttgttccctttgatgcttctaagaatacaggaagagtgtgacgaaaatgtcgagattctgtgatgaaaataaggtaaaagtgtgtaaatttggtgaacacgaaagactggacaatagagaaaatgggatttacattctgaaatccatgttttggtaaaagaaagcctctaaaacttgacaaaaaactacaaatagtggtactgttattgcaaccgcagtaacagcgggatgcaacgaaataaaagaatataataatattgaggtgcgaaaaaatgcaggaattgaaaccaatcaaagaaggtaaagtacgtgagatttatgacaacggtgatagtctgatcatggtagcaaccgacagaatcagttgttttgatgtgattttaaaaaatgaagttacaaaaaaaggaaccgttctgacacagatgtccaaattttggtttgacttaacagaggacattcttccaaatcatatgatttctgtagatgtaaaagacatgccggaatttttccagcaggacagatttgatggaaatagtatgatgtgccgtaaattggaaatgcttcctattgaatgtattgtacgtggttacattacaggaagtggatgggcaagctatcaggaaacaggtaaagtatgcggaattgaacttccggaaggcttaagagaatccgacaaattaccggaaccaatctatacaccatctacaaaagctgagattggagaccatgatgaaaatatttcttatgaagaaagtattgctcatctggaaaaatatttcccgggaaaaggcgaagaatacgctcagaaacttcgtgattacaccattgcactgtacaaaaaatgtgccgaatacgcactgagcaaaggtattattattgcagatacaaaatttgaattcggactcgatgaaaatggaaacattgtaatcggagacgaaatgctgacaccagacagttcacgtttctggccggcagaaggctatgaaccgggacatggacagccgtcttttgataaacagttcgcacgtgactggttaagagcaaatccggataataactggacacttccacaggatatcgtggataaaacaattgaaaaatatcttcagggatatgagatgctgacaggtaaaaaattagtttaaccaaatcaagtaagtcccctgcttcaattgcgaaaagcaataagcagggatggggacttgcttgtatcaggagggggcaagccccttctgataagctgcgtagcagctatttggttatgagcaagtagcgaagcgaattgcgaatatccacttaacggttagcttaatcaatgcaaaagggcaggttctttgtgaacctgcttttttttgtacaaaattataaaaaatatcccccggatagggttctggcatagtagcgaagtagtgtaaaaacaagaaaaaattaaaggaaaattatatccgcgcagggggcttacgaagacttgtaaagttaagtataatgaggaaaacacagaaaccacaggaggaacgtatgaaaaagaaagtagtaagtattttatgtctgacgactatgctcatggctgtttttacggggtgcggagctgaccagagtgaagagacaaagcagacagatgaagttaaagagacaaaacaaacagacgatggagtgcgggcgtatgttggaggaaccatttttgaaagtagtcttgacccaataaagggtgcgatgagttatggatatccttttatcaatgaggcattgctggaagtaaatccagattcggaatatgttggagatttggcaacagattggaaagtaagtgatgatgcactgacttatacatttaatttaaaagaaaatgtaaaatttagtgacggaagtgattttgatgctgaagatgtagtatttacatataagacggtgaaagaaaatcaggcaaataatgaaaacgttgatttaactcgtcttgataaagtgacagccttagataatcacacggttgaatttaaattaagtgaagcatattctccgtttttggataccattgcaatgttacagattgttccttctgatgcttatgacagcgaattgtttgatacacagccaattggaacaggtgcttataaggtgtctcaatacgatgcaaatcagcagattattttagaagctaatgatcagtattatggagatgcgccggaaattaagaaagtaacactggttgcaatggaacaggaggcagctttttcagcagcaaaatccggagagctggatatagtaatggtgggtgcgaactattcaaaagaaaaagtagatggtatgactgccactaattttgaaacaatggatgtaagaaatatttcgcttccggttaatccgacgatgacagcaaaagattcagaaggaaatgaagtggttgttggcaacgatgttacttctgataaagcagtccgtgaagcattatctatcggtatcaatcgtcaggagattatagacaatgcatttaacggtgttggaaaaccagctgtgaattttacggataatttagtatgggcttctatagaaacttatgaagatggaagagtagatgaagcaatcaaattattggaagatgccggctgggaagattctgataatgatggaatcagagaaaaaggtgatttaaagtgtacatttgatgtgtattctcccggtggagatcaggatagatacaatttagcagttgcattggctgaaaatgcaaaaaatttgggaattgatattcaggtaaagactgctacctgggatgaagttaccacacttcagaatacagcgggcattgtatgggggtggggtcagtattcacctactgtattatattcgctgtttaaatcagatttatttttaacaggtgggtatgacaatgtagttggatataaaaatgatgttgtagaccagaaaattgatgaggctcttacagcgaacaatcaggaagatgcaattgcagcatggaaagaagttcagaaaattgcagatgcagattatccggaactgtacttagtaaatattgaacattgcttttttatcaatgataacttagacatatcaatggatacccagattccgcatccacacggacatggaagtccgattgtatgtaatatgaaagattggaagtataagtaaaaaataaagatacggtttttaggtgacctgtctgagataggtcacctattttgggagaaagggataaatgaaaagcgtaaaaaaaattttatcggaagcgattaggatgcttttgttattgatagcagtaagtttggtggcatttattcttattacaaaagcaccaattgaccctcttgtatcttacatagggacaaattctacgttgtcaaatgaagcaaaggaagaaatatcggaatattggggattgaacgacccattgccggaacgatttgttacgtgggcaaatcatgcattacatggagattttggagagtctatcacgtataaaaagccggtaatacagattattaaaacaaggtttttatattcaattgtattgatgctactggcgtggtttttttctggaattttaggatttgttcttggaatattatgtggaatacatcaaggtggtatttttgacaggtttatgaaactattctgtttgattacaaagtctgcgccaactttttggttgggcttgttaattttatcgttgtttgcagttcaattaggatggtttccaatggggatggctgtgccagcgggtaaattagccagtgaggtcacaatctgggatagaatttatcacttgattttaccggtgcttacgttaacgattgtaagtatgagtgatgtaatcctgtacacaaggcaaaaaattgtagagattatgaatagtgattttattttatatgcgaaagcgcgaggagaatctcaaaaacaattaataacaagacacattttgagaaatgttattttaccggctgttactgttcagtttgcatcatttagtgaactttttggaggaatggcattggcagagaatgtattttcctatccaggaataggaacggcaactacggcagcagctttaaatgcagatgttcctttgttactggggattgcattatgcagtgcaatgtttgtatttgcaggaaatttaatggcaaatattttatatggcgtattcgacccgcgaatcagagagggggaagagtatgtctgataaaaaaattgtatggaatagaaagaccaaaattgttgtattaatggtaatcgcagttgtttacctggcagggatttttatatggggaatatttatgaatcctgaaaaatatgcagtaaactatgcaaataaattcttgagtccaagtttaaaacatccttttggaacagattttgttggaagagatatgttttatcgatgtgttaaaggattgtcaaatagtattgtgataggaattcttgcttcaattgttagctcaatagttgcgttaatatttggaatagctgctgctgtttttggaaaatgggtagataaggtggttaattggggagtggatttgtgtatggggcttcctcatttggtactgttaatgttgatttcctttatgttgggaaaaggagtaaaaggagtaacaattgcagttgcattaacacattggccgtcactgactcgaattgtgaggtctgaagttatgcaaattcgttcttctcagtatgttcaagctgcttataaaatgggaatttcaaaatggaaagtggcagttactcatattgttccacatgtgttgccatcttatttgattggtttagtgttattgtttcctcatgcgattatgcatgaagcatctattacattcttaggatttggacttccggcagagatgcctgcaattggtgtcattttatctgaagcaatgaaacatttagctacaggaaaatggtggctggctttatttccaggtctattattgctaattgcagttgttttatttgatgttatgggagataatctgaaaaaattatggaatcctggaagtggtaacgaatagaggtaaaaatggataatagaaaaacagttttagaagtaaatgatttggttgtttcttttagcatgtataaaaaaggatttagaaaagaaaatctggaagtaattcattccttgtctatagatgtaaaagaaaaagaaattgtggctattgtaggttcaagtggttcaggaaaaagtcttttagcatcggcgatattagggttattgcctggcaatgcaagcacaagtggaagtgtctgctatatggggaaacagttggatgataaattaagaaaacagtatcttggtagagagattgcatatattccacagtcggtagaccatttggaccccgttatgaaagttggaccacaggtagtaggggtatattctacagaagaaaaacaacgcaaaatgtttcaaaaatatcagttagataaaagtgtagaagaaatgtatccgtttcaattatccggagggatggccaggcgtgtactgatttcagcggcggtgttggaaactcctaaattaattgttgcagatgagccgacaccaggacttagtgttgatatggctatggatacattaaaacattttagaaaaatagcaaatacaggtacgggaattctactaattactcatgatattgatttggcatttgaggttgcagatcgaattgcagtattttacgctggtacagttgtagaaatttcaccaacggaagattttaaaaagggaaaagaatacttacgacatccctacagcaaggcatttctgagagcattgccacaaaatgaattccagccgattcccggaatacagccttatgctggaaatttgccagaaggttgtttatttgcaaatcgttgtcccgatgtatctgaaaaatgtacgggacaaataccaatgagggagttgcgagggggaaaggtcaggtgtgtaaatgcaacttaaattagaacatattgattttagatatacagataaatctccttggattttaaaagatgtttctttgacaatagaagcaggagaacgtgttggaattgtaggaccatcaggttatggaaaaagcacgttatctaaaattattgcagggtatatgaatccgacttccggaagcgtgatgattgacgaaaaaccgctgcctaaaaagggaatgtgtcctgtacaaatgatatatcaacatccggaatatgcagttaatccaagatggaaaatgaaaaaaatcctgaatgaatgttggactcctggagaagaagtattagctcggatgggaattgaaaaagattggctgaaccgttggccgtcagaattatcaggtggagaactgcagcgtttttgtattgcacgaatattaagtccggatgtgaaattccttctatgcgatgagattactacgatgctggatgtgatcacacaagctcagatatggcaggtgcttttggatactgcgaaaaagaacggttatggaatgttaattattacccataacatggcgctggctgaaaaagtatgtacaaggatagtagaccttagagatattaatcatatcaaacagattgacgtatgataattaatcctgaattattcatggaacaaccatgaataattcaggattagatttatcgaaaaattcagctatagatttccgaccagtttatctttccagataccaagacattctcgcaccagataatttagctgtaaaaatttgttactttttgccggaacaccttctatctgtcggcatcccatcttttttccaatcgaagttcctcgaaatacgtgaaagccgttggttacgattccaattcgtagctcttctggctttttatttaattctttttctaaaagtgcaagtgaatattttaggttttcatttgtattagtagaacggtcttcttttatcagacgtctcgtatcgattccttgtgaaaccagatattcatacattgcttctgcctcggaaatctcttctcctgaaccttttccaccggagacaaccgctattgtttctggattttcattgagatattcttttgcccgcttcaagcgaagcttcaatgaattacttaatttcgttccattgacctgtgcccctaatacaatcagcgtgtccagatttttagatggtttctgagtcattcccgaaaaaatcagaccttctgttatcaaaaatgcaatgactatcaaaatcgccagagtaaggcatactgtttttacaggttttggaaatatacttaaaatattccagtgatgcgttgtttctaatcgtaacaaaattgctattgcataacacacaagccctgctgctgcccagatacacggaaataaggaagaaaatcctgcatacaatacaattccgataaaataaagaatactaaaacttcctaatagaataaataatattctcataaataaaatcctttcactttcgttagtagttttttctgacagaaaaagaagacggaaaaattccgccttctacttttttataattatttgttttttccacagcagtgtttgtattttttaccacttccacatggacacggatcgttacgtccgattttcggtccttttacaactgtaccggattttttctgttctacatataattcttttttcttttcttctgtaaagatttcatcccactgaggaagattgtacagccagtctgcttttgcgtctaccatgtttttgtagagcatttctgtatcaaatccgagatttactacagtgtcttctttcatttcttcgattggattctgtacttttaagctgtcattgattccatcaaggaaaccaaccattgtcataacgtctacatcaaatttttcagcaagctcttttacagttcctctttctacatttgtcgggtctgcaagaagtttttcataaattcctttttcgattaagaaatagtttgtccagaatttctgaagctgtgccctgtctgcttcctgagaatatgcaatctctctccattcctgtaataatgccatgtattttaccaccttttacttaatattcatattttgggcgcaaagcacctatacgtaacagtatatacgatatgcatagatttttcaatgttttttatggattccaggcagattatgcattgcaagcaaaaaaaaacgggtctataatgagaagcgcaaatgaataaatgaaaaggaagaaagagaaatgaatgattcaaaacttacaatccgtggagaacttactcttattgtgattgtcattatcaatagcctcggcgtcgttttgatgcttcactctggctcaggcatatcagccatttcaagtgtgccttatgctttttcggaagtatttccaaaactcactcttggaacctggacttacctttttcaaagtctgcttatcttaactttaatggtacttcggaaaaaatttattccggaatacttatttagttttgttatcggatttttctttggaaaaatggtagatatccatcaggcatgggtcagccagcttccatacacgattccattgcgtgtagtatattttgttttaagttatctcatcatctgctttggaatcgcactttcaaaccgctgtaaaatgccgattattccgacagacctgttcccaagagaacttgcagatatcttaaaacgtgagtattccaaaatcaaagttccttttgatgttacctgcctgtttattaccggatttatgactttcttatgtcttggacatattatgggattgggtgttggaacagttcttgccgcatttactatgggaaaagtaattggaattattggaaaagaaatggataaaaaggttcaatttatttctattatgaagtcttaggtaaaagaaaccaatttttctttcatcctagtattttttaaattatttgtcaatcccattgtatattttaacagaaactgctcatactataagtagtccacggagggaaggcacaaatacgtgacgctcttcttggaagaacaaaagaaaaagtagaaatacttatcctcccctttgaaaagcccctgcacttagaagaagcccaactaagtacaggggttttgttaagtcgtttgattttctgttctgtaaaagataaaaaattaatgcataaaaaatttttttctacacatactgtttttggtaaacgtactctcagggtatgaaaattaaggaggaaataattatgccgttattaaattgtacagcaagaacctgtgtctacaacaaagaggaatactgctctaaaggagatatcgtagtagatggaagcaatgcaaaagttgcagacgaaacctgctgcagcagttttgtggaacgaagcggaagtgcgatgaacagcattggcggagaatgtggatgcaaaacaattgacgtaaactgcaaagcctgccagtgtacatttaacaatcaggagaaatgcagtgcagataaaattacaattacaggtgcaagtgcctgtcattgtgatgaaacaaaatgcggaagctttgagctgaattaagttacagaaaaaagaatcccgggaaacgggattctttttacataaatcccttgacattgcagtttatttatgatatcgtaatacagtctgaagaaaaagaaagcagagtaattgctctcaccttagcacgagtaagtgactatggttcatatttgaaataattgatgcgcttttgcgttttctttatgggaatatgttgtggagagcttatgctgtccactttttatttatttcataggaaattctttcttatttttttcagaatgttatgaggtaggtggctgacaaaaaagtcagatgagtgttttatcaatattatggaggtgcacaacaattagcgaattaatgattaatgaacaaatcagagacagagaggtccgtctcattggcgcaaatggagaacagcttggtattatgtctgccagagatgcgcagaaacatgctcaggaagcaggattagacctggtaaaggttgctcctacagcaaaaccgccagtttgtaaaattattgattatggtaagtataagtacgaattagcgagaaaagaaaaggaagctaaaaagaaacagaaaaccatcgaggttaaggaagtgcgtttgtctccaaatattgaagaaaacgatttaaacaccaaggtcaacaatgccagaaaattccttaccaaaggaaataaagtaaaagtaacacttcgtttcagaggtagagagatggcacatatgcagagcagtaaacacatcttagatgagtttgcacagtccttatccgatattgcggttgttgaaaaagcaccgaaggtagagggacgcagcatgaccatgtttttgacagaaaaacgctagacgttcattaaaagagttttaaggaggatacaatcatgccaaaaatgaaaacaacaaaagcagctgcaaagcgcttcaaaaaaacaggtacaggattattaaaaagaaataaagcttataagagccatatcttaacaaagaaatctcagaagagaaagagaaacctgagaaaagcagctattacagatgctactaatgtaaagaacatgaagaagattttaccgtacatctaattcgatattcgttttaaaacaggaggaaattaagaaatggcaagaatcaaaggcggattaaacgcaaagaaaaaacacaatagagtattaaaaatggcaaaaggatacagaggtgctcgttctaaacagtacagagttgcaaaacagtctgtaatgagagctctgacaagtgcttatgccggaagaaaacagaaaaaacgtcagttcagacagttatggatcgctcgtatcaacgcagcagcaagaatgaatggtctgtcctacagcaaatttatgtatggattaaaactggctaatgttgacttaaacagaaaagttttagctgacatggctatcaacgatgcagaaggatttgctacattagcagaacttgcaaaatctaaacttgcttaattaaaattagaagtgagaaatcaggcaggagatgaaatttttgaatttcatttcctgtctttttttaaatactattgacggaaatataaaaaagaagtaaaatgttcgagaagaatgtataaatttagaaacaggcagtgaatcctgtaggtaggattcttttttttcgccttttgtgtacgcgcagcacgtgcaaatgtgtttgagatttatacttcttcaggttttaagtcaagaggaggaaaaaaagatgaaaacctacaagaaaatcatggatgtgcttgccggtatcgaaaaattgattttagttgtatcaacgattttgattctggttctcacagttggaaatgtattttcaagaaaagtcatccaccgttcctggtcttttacagaagaactggtggtagcagttttcgttctgattaccttactggcagcagctcttgcatgccgagagggagagcttgtcagtttaaatctggtaacagaacgactgccgaaaaaaacaaaaaaaccaattgcaattttagtgactgtattatctgtaatttttacaatgatactgttctattacggaatggataaggtactgacacagcttgcaaatggaaaacgtacattcgtattaaattggccggaatggattttctggtcctttgtaccgattggtgcaggctgcatgattcttcattttattgaatactgcattgatttttgtacagactttaaatttgcaaagagaaaggaggaggcataagtgattagtgcggttttattcttatcattttttgtattcttaatcttaaatgtgccgattgcgatttgccttggactttcttccgtatgtgcaatcttatattcgggaacttctttaacaatagtggcaacaaatatgtattccggaatcagtaaattcttattgcttgccattccatttttcgtattatccggaaatatcatggcaaaagccggaatttcaaaacgtctgattaaatttgtaaatacctgtgtaggacacagaagaggtggtattgcgattgtatgtgttatcgtagcctgcttctttggcgcaatttcaggttccggtccggcaaccgtagctgcgcttggtgcagtcttaattccggcaatggtagaagaaggaggattttctgctccattctcaacggcaatgatggcaacttcaagttctatcgcaattgtcattccgccaagtattgcattcgtagtttatgcctctattacaggtgtatccattgcggatatgtttgcaggcggaattattccgggtgtcttaatgggtctggcactgattgttgtaattatgattgaagtgcgtaaaaaaggaatccagccgacaaccaaaaaagcaagttggggagagcgtggaaaagcgtttgctgatgcattctggggattcttaatgccaattattattcttggcggaatctatggaggaatctttactccgacagaagcagcagcggtatccgtagtttatggtctgtttgttggtatggtaatctaccgtgaagtaaaatttaaagatctggtagatatctttgtagagtctgcaaagacaaccggtggtatcatgctgatcgtagcatgtgcttctttgttttcatttgtatgtaccaaatttggtatttcgcaggcagcgtcaagtctgctctccagtgtagcacataatcagtttacgtttcttttaattgtaaatgtaatcttcttaattgcaggatgctttatcgatgcaaactctgcaatgtatatttttattccgattatgcttccggtttgcaaagcacttggatatgatttagtcgcctttggtattgttgcaacggtcaaccttgcaatcggacaggttactcctccggtaggtgttaatttatttgttgcaatcagtgtcaaaatcaaaaaaggactggaagttacccttcaggaaatttccaaagcggtgctcccgatgattgcagcctgcgtagttgtccttttgatggtgacttatattccgcagatttctacttgtctgccaaaactcttcgcaggaagttcttatacaggaacatcgaaacttgcagcagatgattctgaggcagaagagagccagtctgatgatgactataatcagattgatgattacagtgaccttggctgggaagaacagacctggaactttgcatgttctaccaccgaaaccagtacctgggcacaggccggagaacagtttggaaaattaatggaacaggcaaccggcggtaaagtaaaagtaaatgtatacgcagcagaccagctgacaaacggaaatcagtcagaaggcattcaggcacttatgaacggagatccggtacagatttccatgcattcaaacctgatttattctgcatttgatgcaagatttaatgttgtatctttaccatttatttttgattctgtagaagatgcagatgcgaagctggatggcgaagcaggacagaaattagatgaaatcttatctgagtacggacttcactgcatgggtatggcagaaaacggattcagacagttgacaaactctgtcagaccggtaacttccgtagacgacatgaaaaacttaaaaatccgtgtagcaggctctaacctgttaatggaatgttacaagagatggggcgcagatgcgaccaacatgaactggtctgaaacttatacagcacttcagcagaatacagtagaaggtcaggaaaatccacttccggcaattgatgctgcaagtgtacaggaagtgcagaaatactgctctatgtggaatgcaaactatgactgtctgttcttctgcatcaaccaggatatctacgatgcactgacaccggagcagcaggctgtagttgatgaagcaggtaaaaaagcagttgattttgaacgtgatatcaaccgttccggtgacgatgaaatcaaatcccgctggtcaaaagaaaacggtgtggaaatcacagagtacgaagaccttgacattggttctttcaaagatgcagttgcggacattccgcagtggtatgaagaacagctggttgcagaaggatttgacgaggcagaagtaaaagatttaattaatgtatttactgcaaaaagcagtgcaggaaattatgaagtagaggacagaagtgacttagactggaaagaacagacctggaactttgcatgctctactacagaaaccagtacctgggcacaggccggacagaaatttggcgaaatgatggaacaggcaacaggcggcaagattaaggtaaatgtgtatgcagcagaccagttgacaaacggaaaccagtcagagggaattcaggcacttatgaatggagacccggtacagatttccttacattcaaacttaatttactctgcatttgacccgagatttaatgtggtatctcttccattcttatttgattccgtagaagatgctgacgcaaaactcgatggggaagccggagaaaagttaaaatctattcttgaagactatgatattcattgtatgggaattgcagaaaatggattcagacagttgacaaactctgtcagaccggtaacttctgtagatgacatgaagaatttaaaaatccgtgtagcaggttccaacctgttgatggaatgttataagagatggggcgcagatgcaacgaacatgaactggtctgaaacttatacagcacttcagcagaatacggtagaaggtcaggaaaatccacttccggcaattgatgcagcaagtgtgcaggaagtacagaaatattgttcgctgtggaatgcaaactatgactgtctgttctttggaatcaatcagggtgtttatgatgcactgacaccggagcagcaggaagtagtcgatgaaatcggacagaaagcagtacagtatgaacgtgaaatcaatcgtgcaggagatgacgaaattctctcccgctggcaaaatgaaaacggtgtagaagtactgaaaaatgaagagcttgatgtagagtccttcaaaaaagcagtagatggcattgacgaatggtttgtagaagaattaaagaaagccggatatgatgacggtcaggatcttgtagatgcatttgaacgcagataagcattcccccgtttcaagtgcgcagagcactaagcggcgggtgaaggggatgcttctgtcagtgagagttgaaagctcccactgacagagcgcaaagcgactgcgttcatgagcaagtagcgaagtggattgcgaatgtccgctttactgcagataagcattcccccgcttcaagtgtgcggaacggatcgcgaatgtccgctttacaaataaaaaattgtaaaaatgtaagttttagaaagccggatacttttttggaagtatccggctttttttgaatatattgttataacaagtaaaactgagaatttggatagaaaagaatgaagcgaataaaaggattagccggtattacgattttattttttatgctaatcgccgtggcaggtttagatggagactttgataaaaaagaacaatctgtatttggagcactttcagatgaggaacatccgaaaattgcactgacctttgatgacggaccccatccggtttatacagaagaactcttagatggtctaaaaaagcgaaaagtcatggcaactttttttctgattggaaataatatcgaaggaaatgaagagattgtaaaacggatggcagaagaaggacatttaatcggaagtcatacttataaccatgtgcagttaaataaactttcagaattgaaagcgaaagaagaaatattaaaaggctgtaataaaatttatgagacaaccggagtctgcccttcatttgtgcgtccaccgtttggggagtggaagaaaaatctggatttttgtgtgaccatgcttcctgttttctggaatgttgattctcttgactggaaactgcaaaatacagaaaaaatcgtaaaaagggtagtgaaagatgtgaaagaaggtgatattattttaatgcatgatatttttgaaacttccgttcaggcggcatttcagattattgatacgcttgaaaaagaaaactatgaatttgttacggtagatgaattgcttttggaataaatttaagcaagaagctcggttgcttgtagccgagtagttcacgaactatatagaaaacgtattttaaaaaatgtattttacgaaatggagaaggttatggatttatttgattatatgaaagaacagactttagaaaacgaatctccgcttgcttcaaggatgagaccggtttctttagaagaggtggtaggtcaggaacatattattggaaagggaaaactgctttatcgtgcgattaaggcagataaactgagtagtattattttttacggacctccgggaaccggaaagacaacacttgcaaaggtgattgcaaatacaacaagtgcaagattttgtcagatgaatgcgacggttgccggaaagaaagacatggaagaagtcgtaaaaacggcacaggattatcttggaatgtacggaaaaaagacgattttatttgtagatgagattcatcggtttaataaagggcagcaggattatctgcttccgtttgtagaggatggaacgctggttttaatcggggcaactacggaaaatccgtattttgaagtaaacagtgcgttgatttcacgctcaattgtgtttgaattaaagtcacttgaaaagaaagatattgataagctgcttttaagggcggtatcagataccgaaaaaggaatgggtgcttatggtgcggtattggatgacgatgcaagagaattcctttcggatattgcaggcggagatgcaagagcagctttaaatgcattagagcttgccattcttacaaccgaaaaaagtgaagatggaaagatacatattacattagaagttgcctctgaatgtattcagaaacgagtagtgcgttatgataaaaccggagacaatcattacgatacgatttcggcatttatcaaaagtatgagaggttctgatcctgatgcagcagtttattatctggcaaagatgctttatgccggtgaggacattaaatttattgcaagaagaattatgatttgtgcttcagaagatgtaggaaatgcagatccacaggcacttcaagttgcagtttcggcagctcaggcagtagagcgggttggtatgccggaagctcagattattttatcgcaggcagttttatatgtagcgtgtgcgccaaaaagcaatgcggcatatatggcggtttttgatgcaatggaaaatgtaaaacaggtaaaaacaaccgttcctccgcatcttcaggatgcacattataaaggagcgtcaaattttggacgtggaattggatataagtatgcacatgattatccgaatcattatgtaaaacagcagtatcttccatctgagatagaggggacgaaattttatcatccaagtgaaaacggatatgaaaaacagatacaggaacatttaaaaaaaattgctgagcatgctacatgagcatgtccagcagtttttcatatacggctttattttttgtctgccaggaagcacacacggcttcagcggcagcttttgtcggaacggtcatagttaattcaataagcggtacttctttttcttttgcgctgcatcgaacctgataaccttctttttctcctctgtaataattggcaaaggttgaaagttcttccttgatttccattgcattatttttgaaaaattcagcaatttctcctttgatttctttaggaatttcttttccgaaatactcaagtgtctgttctccggattttgtaatcgagaaataagaagaatttcggatagtttcgcagtggattaactcggattcggttaactctgaaagtgcctgctgtaaatggaaataggtagtatatcctttatcaagaataaatccggaaatctgtgcgttggttagtggaaaatctaccttttccagcatatagagtacaataagtttatataaagtaagtgattctcccatgagagtcctccttttaaatgtaatgttctcttgaaatcttttatgatagttacagaaaaaatccaagagtacatttgtgataggttttcaggtttcatgaaacagtctgccctgccaggtgtttcggattttacactcatgatgaagggtgtttaatactgttttttttgcgctgctccataaaggggcgattaaaagtgcttttggaccgtctcctgttacgcgatggacaacgatgtctggtgaaaggcgttcgaggcagctgatgaccaaatcaatatattcttccatggagtagactttaaatttaccatccagataatcagaagctaaatcggttccttttaaaacatgcagaagctgaagtttaattccctgaatgtctttgtgatttaaataatcaatcgtttctaaaatatcttcttttgattcgcctggcagtccaagaatggtatgcacaatgacttcaagccctgcgtcttttaaattttttactgctgtttcaaaacaggagagtgagtagcctctgcgaatgtagcgagcagtttcttcatgcatggtttgaagaccaagttcaacccagacaggctttatctgattcaaacgttttagaagtgcaatgacatcgtctccaaggcaatcggggcgtgtgccgatagaaattgcgacaacatcgggataagaaagtgcctctgtaaaaattttttccagatagtcaacgggagcgtaggtgtttgtgtacgcttgaaaataggcaataaatttttttgccccacgtttttctctaaggcggtcagcctgaatcttaatttgggtggtgatgctgtcacgggaatttccggcaaagtcgccggaacctccggcactgcagaaaatacagcctccgtttccgagtgtaccgtcacggtttggacagctcattcctccatttaatgctactttataaactttggtggaaaatcgttcctttagcattgcatcgaatgaatagtaaggttttccattccaagaatttgccataataattcaatgactccttccagtttttcttttagctctatcataccattagcaaaatccttttgcaagaaccgaaggcacatatttgacaaagaagagggagcatgatatcgtagtgttagcaaaaaggaatgtatgcgttaacaaaaacaaaaagtgaggtaaaaactgtgaaaaacataagaagaaaactgggagcagtagtgttagccactgttttaatgataatttccctgtcgggttgtagtgcggggaatacatcttctgatggaagtatttctactatagaaaagggagttttaaaagtcggaatgaatttaaatgattctccgatgagttatttaaataccgataccgcaagaccggatggatttgaggcaaaggtagcagagcaggtagcggaaaaacttggattaaaacttgaaattatcgatactacccagaaaaatttattaaaatcattagatgcagacatttatgattgtgtgatttcaagtgttggcatgacagaagaaaactgtgaaaaatatgaagcaacaaatgcttatgcagatgtcagtgcgatagaagatgagttaactgaaaagccgaaaaataccaaaattgctatctttggtaagaaaaataatggattaattcaggcaatcgaaaaacaggcattagagccgttaaaagaggatggaacactttcagaaatttcaaagagttcgttaaaagaaaatattattataaagtaaaagaaaaattctacttgcaaaattgcaagtagaatttttttataaaaaaagcaaaaaacgacttgattttttttacattcgatggtagcataagtatatagtttaatgactaaactaattaagaaggaggtaacgtcccatggaaattttaaatgtcatggacaaagcatttgctccatacggaaaagtcgtaacaggacttaacgtaagcgatcttctggctgcacttgagaaaacaccaaagccggatgatgttatttatgttgcttcagatgaagcccttgaagcctgtccaagcgtagataagattgcttacagtctttttggaggaatgccgattcaggtaggttattgtaatggaagcaattatctgttgaatgcagtggaataccacagagatagtgaagtcaatgtagcattaacagatttaatcctgattcttggaaaagagcaggacattgaagctgatggtacatatcagacagagaagatggaagcatttcttgttccggcaggaacggtcgtggaagtatatgcaaccacccttcactatgcaccatgtaatgtaaatgaaaataagttctgtacagcagtcattcttccgaaaggaacaaacgaagatgcaccggcaccacagaacaatacagcagaagacaaactgctttttgcaaaaaataaatggctcatcgcacataaagatgcaaaaatccagggcgcttttgaaggattgattggagaaaatctttccgtaaaataagaaatttaaaatcaaatttttagtttcatttttcaggaggaaaataaaatgaatttatcaaatatgccacaggcaaaattaggtattgtagcagtaagccgtaactgtttcccaaaatctctgtcagaaaacagaagaaaagcagtagcagctgcttataaaggtgaaatctacgaatgtccaacagttgtagaaaatgaaatggatatgaaacaggcattaaaagaactgcgtgaagcaggatgtaatgcattagttgtatatcttggaaactttggaccggaaacagaagaaactttactggtaaaatacttccatggaccagctatggttgttgcagcagcagaagaaagaggagacaacttagtacagggtcgtggtgatgcttactgtggtatgcttaacgcaagctacaacttaaaactgcgtgaattaaaagcatatattccggaatatccagttggaacaccggaagaagttgcggatatgattgctgaattcgagccaatcgcacgtgcaatcgttgcaatcaaaaacttaaaaatcatcagctttggaccgcgtcctacagacttccttgcttgtaatgctccaatcaaacgtctgtatgatttaggtgttgaaatcgaagaaaactccgaacttgacctgtttgaaagctttaacaaacatgccggagatccacgtatcgaaggtattgtaaaagaaatggaagaagaacttggagaaggaaataaaaaaccggaaattcttccaaaacttgctcagtatgaaattactctgcttgactgggtagaagctcataaaggtgcaagacagtatgttgccctgacaacaaaatgctggccggcattccagacacagtttggttttgtaccttgctatgtaaacagccgtttaacaggaagaggacttccagtatcctgtgaagtagatatctggggaacattaagtgaattcattggtactgttgtaagccaggatatcgttactctgcttgatatcaacaacacagttccggctgatatgtacaatgatgaaatcaaaggaaaattcaactatacacataaagatacattcatgggattccattgtggaaatacagcttcccagaaactgtccttctgctctatgaaatatcagatgattatggcaagagcacttccggaagaagtaacacagggaactcttgaaggagatatcatccctggagatatcacattctatcgtctgcagagcacagctgactgcaaacttcgtgcatacatcgcacatggtgaagtgcttccggtagcaactcgttcctttggtgcaatcggtatctttgcaattccggaaatgggacgtttctatcgtcacgtactggtagaaaagaactatccacatcacggagcagttgcttttggacacttcggaaaagcgctctatgaagtatttaaataccttggcattgatgtagaagaaatcgactacaaccagccaaagggaactctgtacccaacagaaaatccatttgcataatttttgcaggtaagaatcaaaaatggaggctgcccgaaagagcagcctcttagtgaataaggagaagaaaatatgttatacattggtgttgaccttggtacatccgctgtaaaattactgttaatgaacgaagaaggcaaaattgaaaaaatcgtttccagagaatatcctctctcttttccgcatccaggctggtcagaacagaaaccggaagactggtggacacagagtattgagggaatcaaagagctgacagcagaatgtgataagagtcaggttgcaggtatcagctttggtggacagatgcatggtcttgttatcttagatgaaaatgatgaagtcattcgtccggcaattctttggaatgacggaagaacaacaaaagagactgcttacttaaatgaagtaatcggaaaagacaaactctctgagtatacagcaaatattgcatttgcaggatttactgcaccgaagattctatgggtaaaagaaaatgagccggagaatttcaaacgtatcaaaaaaatcatgttaccgaaagattatctggcatataaattatccggtactcattgcagtgatatgtccgatgcgtccggtatgctgttaatggacgtaaaaaatcgttgctggtcaaaagaaatgcttgatatctgtggaatcacagaagaacagatgccgaaattgtttgaaagctatgaaacagttggaacattaaaaccagaacttgcagaagaactgggaattccggcaacctgtaaaatcgtagcaggtgcaggtgataatgcagcagcagcagttggaaccggaactgttggtgatggaatgtgtaacatttcccttggaacaagtggaacaatctttatttcaagcaaggaattcggtgtagatccacacaatgcacttcatgcatttgctcatgcagatggaaattatcacttaatgggatgtatgttaagtgcggcttcctgtaataaatggtggatggatgaaatcatcggaacaaaagattatgccggtgagcaggcaaaaattgaaaaacttggtgaaaataatgtatacttcctgccatatctgatgggagaacgctctcctcacaataatccaaatgcaagaggaactttcattggtcttacaatggacagcacaagagccgatatgacacaggctgttttggaaggtgtcgcttttgcaatccgtgattcctttgaggttgcgaaatctcttggaattaagattgaacgcacaaaaatctgtggcggcggtgcaaagagtccgttatggaagaaaatgattgcaaacatcttaaacatcaaagtagatgtaattgaatccgaagaaggaccggcacttggcggtgcaatgcttgcagcagttgcaaacggagagttcgcttccgtagaggatgcagcagctaagattgtaaaagttattgatacggtagaaccggaaccggaactggcagcaaaatatgaagaaaaatatcagaaatttgctaagatttatccgacggtaaaagatttatttggcgaattactgtaatagatattcaaatttgaacgcagataagcattcccccgcttcaagtgtgcgaagcactaagcgggggaggggggatgcttctgtcagtgggagttgaaagcttccactgacagaacgcgaagcgactgcgttcatgagcaagtagcgaagcggattgcgaatgtccgctttacagcaggagacagtgtacagaaaattttttctatacgctgtctttttttgcgttgtttttacgatgttaatgctatagtgtaataggaaaacatacttgattttgaaaaataagagcggtataataaaagccctgttagcaagaaaaaattttacagaggagaaggaataaagactccgagaatacataattgaatcaggaggagagtatcatgaaatacgtactggatgtgcacacacatacgattgcaagcggacatgcctataatacgattaaagaaatggcacagtctgcatcagaaaaagggctggagttgttgggaatcacagaacatgcaatgaaaatgccgggaacctgtcattcgttttattttgcaaatttaaaaatgctggaacgaaagatgtttggggtagaaatgctgtttggtgtggaacttaacatcttaaatcaagacggtgaagtagatatggaagaaaatctcttaaaaaaaatggacatcgtgattgcaagtatgcatataccttgctttaagtctggtacaaaagaagaaaatacacagacttatttaaaagttatggaaaatccttatgtgaatattatcgggcatccggacgatggaagatttccggtcgattatgaacagctggtacttggagcaaagaagcatcatgtacttctggaagtgaataataactctttagaccctcgctgtaccagagaaaatggggaagagaatgtaaaggacatgctttgctattgtaagaaatatgaagttccggttgtggtggatagtgatgcacatacagatgctctggttggctgtcactgctttgccgaaaaagtaataaaagaagtagattttccggaagaactgattataaaccgttcagtagaagaactgaaaaaatttcttaataagtaaattttgaaaatactgctttactttaaaattttagtgtgttaatataggaagaagagaagtcatattggggtgacaaaaatatacgttatgataggagagttagaattatgagtaaaaaaattcatacagaagcagtcgattctttatttgatgcgattttatgtttaaaagatagagaggaatgttatacattttttgaagatgtatgcacaatcaatgaaatcttgtctttgtcacagcgttttgaggtagcaaagatgctcaaagataagagaacttatcttgatatttccgaaaagacaggtgcttccacagcaaccatcagccgtgtaaatagaagtctgaactatggaaatgacggatacgaaatggtatttaagagaatggcagaaaaaacagaagaataaaaacagaaaagaaaaagtcaggagaggaccttttaaaaataaaaatgtgtacctctccatttttttgagaatttttacaatttattatttcttactgttcttattcttatttttcgtctctttgggctggttatctgccatatcgtctataatcttttcgataacctgttttttaacatatacgtcaaaactgagcatacagatgaaagagaattttcggagaaaatcctgctcttcttctgttgcgtgctcaaaagaactgcaggcaagtttatattttttggtcacgtctttggcaagtggctcaatctgcttaagttctaagttcataatttcattatagagttcggtcatatccattgagccgtcaccggaaaaataattttgggaaatcgggtcaagcagggtctggatatcattgatacataaaatattttttaaataataaataaaagtaagcattaaaagatgctcttttgaatatttctttttgaccggtggaggtaacaggttattttttgcatagttgttaatcatggttttcgtcaggattttatctccttcatgtcttcttgaagaagaaagatgactctccataaatgtcgttacctgatccatatataaatcaatttccggaatttcttcgggtttaatataagaaatacgagaaatgctttcaagaatactattgagcatgtcttttgtgtcaattgtcattttatcacctctatgctatattatatagttttcaaaactatttgtaaacgaatttctgtaaaattttcacgcttgaagccgataaggggagtatggtatattgtagaaacaggtgacactgaaaaataattttaaagaaggtgcaggtttatgagtatatatgataccttaaatccggaacagaaagaagctgtcttacagacggaaggtccggttttaattttagcaggtgccggttctggaaagacccgtgtgctgacccatcgaattgcctatctgattgatgaaaaaggggttaatccgtggaatatcatggcgattacatttacgaataaggcagcaggtgaaatgcgggaacgagtggataagattgtgggatttggctcggaaagcatctgggtttcaacctttcactcaagctgtgtgcggattttaagaaggtacattgaccgcttgggttatgaaaataattttacgatttatgataccgatgaccagaaaagtctgatgaaagaagtctgcaaaaaactgaatattgacacgaaaatctataaagaacgtgcgattttaggtgcaatttcttctgcaaaggataatctggttggcccggaagaatacgaaaaaagtgtgatggacgattacggccggaaaaaaattgcaatggcgtatacagagtatcagaaagaattaaagaaaaacaatgcattggactttgatgatttgattgtaaaaactgttgaattgttccagagctgtccggatgtgctggattcttatcaggaaagatttaagtatattatggtagacgaatatcaggatacgaacacagcgcaatttaagtttgtcagtcttttagccggcaagtatcagaatttatgtgtcgttggtgatgacgatcagtctatctataagttccgtggtgcaaatatcggaaatattcttggatttgagaagatatttccaagagcaagagtaattaaactggagcagaattatcgttccacaaaaacaatccttgaggctgccaatcaggtcattcacaataatattggaagaaaagcaaaaacgctttggaccgataatgaaatcggtgaacccgtgcattaccgtcagtttatgaatggttatgaagaggcagaatatatcgcaggagacattagtaaaagggttcgtgagggagaatgtgaatataaagactgcgcaattctatatcgaaccaatgcacagtcccgtatgtttgaagaaaaatttttgatggcaaatattccatacagactggtagggggcgtaaacttctatgcacgtaaggaaatcaaagatttgctggcctatttaaaaaccgtagataatgccagagatgaccttgcagtgcgtcgtattatcaacgtgccaaagagaggaattggtgctgcaagtctctctaaagtgcaggattttgcagaccagaacggaattggattctatgatgctttgcaaagagcagatgaaattacaacacttggacgtgcagtatctaaaattacaccatttgtaacctttattcagagtttaagaagtaaattggactatatcagtccgtctgaattattgaaagatatcattgacgaaaccgggtatgtgacagaacttcaggcagaaaaaacagaagaagcggaatctcgaatcgaaaatattgatgaattgattacaaaagtggtaagttatgaagaagaatgtgaagcaaataatgaggaaatcagtttaagcggtttcttggaagaagtagcgttgattgcggatattgacacggtagatggagatgacaaccgtgtacttctaatgactcttcacagtgcaaaaggtttggaatttccttatgtatatctggcaggaatggaagatggcgtattcccaagttacatgaccattgtgtcagatgacccgactgaaatcgaagaagaaagacgtctttgttatgttggaatcacaagagcgatgaaagatttaactctgacctgtgcacagcagagaatgattcgtggagaaacccagtataataagccgtccagatttatccgtgaaattccgaaggaattagtagaccttggaaaaaatttcaaagaaagaaaagtaaaagaaattccgcttccaaaaggctaccagcagatgaaaaaagcaatcaaagagccggcatttatgcagaaaaaatttgaggtaaaaaaagcatccagcctttcttatgatgtgggagatactgtcaaacatatcaaatttggaactggtgtggtaaaatccattgttgatggtggaagagattacgaagtaacggtagattttgaaaaagcaggcgtaaaaaagatgtttgcctcctttgcaaaattaaagaaattataacattatttcaaaatgcaaaagataaaggtacaaatacgggaaagaaaagatagtaaaattcccataagcgtgatataataatggaaacagccaaagtaacggacttaaagttgccggaaagtaagtttctgtgcaagagaggaaggtgtagtatcatgaatcgtattgaagatttagtagcagcattgcagaaaagggaagaggagaaaaataaaaatacagttttatggattctcgcaattgttggagctgtatctgtagttgcaggaattgcttatgcggtttatcgtttcttcacaccggattatctcgaagattttgaagaagactttgatgatgatttcgatgactacttcgaggatgatgaggaaaacgaagaacacgaagaagataaggacgaagagtaacaaaataataaaaagaagcttcgggaaaccggagcttcttttttagaaagaatgaaatagaaaataaagaagaataaatagcatcagatatggaggtcgaacatttgaaaaaaggtgaaatttatgaaggcgtagtagaaaaaattgaatttccaaataaaggaaaagtaaaagttggagaagaaacggttattgtaaaaaatgcaatcccaggtcagaaagtccgttttatgataaataaaaaacgtggaaaaaaattagagggacgtcttttggaagtattagaaaaatctcctcttgaaaaaagagaaccggtctgtagcatttttccggcatgtggaggctgtatgtatcagaccatgtcttatgaagaccagcttaagatgaaggcaaagcaggtaaaagaacttttagatacagcagtaaaaaatggtggacaggtagacgaaaacggaaatccggattatgtatttgaaggaatcaaaggaagtccatttgaatttgcttaccgcaacaaaatggaattttccttcggagatgaatataaggacggaccgcttgcacttggactgcacaaaaaaggcagtacttatgatgtgttaagtgcccgtgactgtaaattggtacatgaagatatgacaaaaatcctttgttgtgtccttgaatattttcaggaaagaaagaccagtttttataaaaaaatgcagcatgtgggctatctgcgccatctgctgttacgccgtgccaacacaaccggagaaattttagtcaatctggtaactacaagtcaggaagaaatggatttaacaccattaaaagaagcacttcttgcattggatttggaaggaaaaattgtgggatttcttcatattatcaatgatggattatccgatatggtaagaagcgatgagacgagaattctttatggacaggattacttctacgaagaaatcttaggattaaaattcaaagtgacgccattttctttctttcagccaaattcttacggtgcagaagtactttacaatactgcaagagaataccttggaagtacaaaagatatgaccgtgtttgatttatatagcggaaccggaacgatttcacagattttagcaccggtagcaaaagaggtaattggtgtggaaattgtggaagaagcagttgaagcagcaaaagcaaatgcagctttaaatggaatcgaaaactgccactttatcgcaggcgatgtattaaaagtgatcgatgagatcaaagaaaaaccagatacgatcgtgcttgacccgccaagagatggaatccatccaaaagcactgccaaagattattcagtatggagtggataagatcgtgtatatttcctgtaaaccatccagtttggcaagagatttggaagtgttcttacagagaggatatcgagttgaaaaatgtgtgtgcgtggaccaattttgtcagacggtgcatgtggagacggttgttcttttgtcccaacaaaaaccagatgacacgatagagatcgacttagacttagatgagctggatgcaaccagtgcagagacgaaagcgacctatcaggaaatcaaagattatgtgctgaaagaatttggcttgaaggtttcaaatttatatatttctcaaatcaaaaggaaatgtggaattgaagtaggagagaactataatctgccaaagacagaaaatccaaaagtgccacagtgtccgaaagagaaagaagatgctatcaaggctgccctgaaatattttgcgatgatttaaggatatcgctgatttcaaggaggaataacacatgaaaagcacatttgaaaaaatgggtggaacctacacactgggagcagacggaatttactatccgaatcttgtcagtacagatgaagaaccgcattatggaaaatatggaataatgcggaaaacgtatctgaaagagcattgtccggcaatgtattcactgtatatgttggaagacagactggtggaacatctgaatcttgtggatgatgaagcgcaggagagaatggaagttctggtgcatcagatgatggagaggcagggcattacggaagaaatgaaagctcgtgaccagatggaatgggttagggcggtaaatggtattcgtaatatggcagaagagattgtgttaaaagaattgatttacaggtaaataaagagctgaacaggtaggaagaaaactcctatttgttcagcttctgcatttgtaagggttcaaagaagaatcaaattacaattccatatcaggtgaccatttctaagttccggaaggttgtttttttctgccatggttataagttacacagatttaattacttcatagtatggcttaaaaaatatccgaatataacttcacagaaataattataatggggagattatttgatatatttgtgctaatattctgcaattctactgctagtcgattgatttatgcgtactcccattataatatgtgtgcaggaggtggatgtatgtatcaaattagtaatgaaaaattcggtttatttgtaaccgaattaagaaagaaaaagaatttaactcaaaaggatttggctgaaaaattatatgtatcagataaaacggtcagcaaatgggaacgtggtcttagtatgcctaatgtcgtattactcataccaatagctgatatattagatgttaccgttacagaattgttacgtggagaaaaaatagatacacagaaaaatattgatacaaaagaagtcgaggaattggtagtaggctctctcgatatggctgttaggaattctattcatcagcatagaaaaaactggatattagcatatttgctatgctttttaatatctattacagaaattattatgttagtcgtatctgggaattcaatagctgagatgaaagatgatatattgctggttacagggttaatgcttttatttggtgcatggttttgtttctttgccaaagacatattaccaacatattatgatgcaaacaagataaattatgtttcacaaggaatttttagaatacatctagttggtttatcctttaacaacggaaattggatgtacatctgtacaactttaaaaatttggacacttgcaacggttgttctatatcctcttgcaggtattataataatcaattgtctcaatatagctttatgggatattttaagtaaaattttcttaattatgatattaggtggtatggtagtttcgatttacattatcgggaaaaaatacgaataattaaattacctgttatcgttgtggatattactaatttacaacattcttcatgggaaataagaaatgatgcagaagagattgtgttaagcgaattagcatacatttagaacgtggaaagctccttcgggagcttttttctggtttttgctgggtatcaagaaagtatatagaaaatgcattaatcatatggtatgatttgaacagaagatagaatcttaggaagcaagaagatttttgaggaatgtaacttagaagttatagaattaagttaatcgtgccatatggcttgattataaacgcaaagataaaaacgcaacgtacatctttgatgtgccagagccggtaggtagcccggccgtcctatataaatagggtaagtaacctgcccctccgggttgtccattctttgttcaatcaattttaggagggattcttatggacaaagtaaatggaaagctgacagtattttttgaagagccgttttgggtgggaatctttgaacgcatcgaagatggtaaactatctgtggcaaaggtaacatttggtgcagagccaaaagattatgaagtacaggaatatattcaaaagtgctatttcagtttgaaattcagttcggttgttgaaactgttgtaaaggatatcaaaagaaatccgaaacggatgcagcgggaagtaaagaagcagatgctggaaataggcattggtacaaaatcgcaacaggcgttgaaattacagcaggaacagaacaagcaggaacgcaaagagaaaagacgcaagaaaaaagaggcagaagagcagcgaatgtttgaactgaaacagcgaaagaaaagagaaaagcataagggacattaaagtcccttggccttttactcaaatcgaaaagtgttgaataaagctttcgggaggtgtttctatgaagaaaaaagtacttgcaattatgttagtcgccatgtcaatcatgttgatttcagcgtgcggaaaaaaagaaaaattgtacgaaattcctgatttatcgcagtataagacagattatgtaggagattcttcaaatgttataaatattgtaagcggtcaagagtatccagagggatactcatatgacagtatagagatacagtctgaaacagagccttatggattaacagtttttctaaaagatgagccgtcggcagtcaaacttgaagatcaattgcaggttaatgcagatatgacatttgacttgattggtaatttgggaacaattgattataaaacagcagatagcaaagaaattattgcatcatatgaacggtgatatatttttagtcaacttttagacaatttgaagaacggaatataaaaaggcgtatggaagttttaaatccatacgcttttttgaaaaaaactcatttttgaacaagagatttgtaagaacatattatctattcaaagacggttacaattccatatcatgtgattttttcttagattgagcaggctgatttcgccgtatttcccgtttcctctgatatttcagttcccatgcacgatgggagaagacatcaggatcttccacattgagataatccacctcattggctgcaatatcacgacggtgatagtcataatatttaccgaaagtacctttaagctgttcgatcagcttatcccgaaaatcaggacgtatctggattctggtgtccagcaattctgtgtattgttctggatcaggacgaaatttttcttcccggaaagcaacggcgtctttttcaagctgttttttaagggagatgtcctgagaatcaagaatatcaagattgttattcatctggtcatatttcttggatagattcatcatatctttatcagtagagcattgtgcctggaagattagctgctctttccttgatttcagttcttcaatttcttcggtaacagttgtaagctgctgattcaattttatatgctggatgggattcaaaatactggttttctctttttctacattcagctctttccgttctgtaactttagctttgagtttctttttaacggtgttgtatttattcagtattggattaaaatgattcatccaatcatgaattacttctttttgcatctcattatgaagtaaatgatattgtgtaaagatcatatgatttcggatagtttccattgtttctgcaattacaggaatagaatttttgacagcttgagccagtttctctacctgagcttttaattcccggagcatttggttatctgcacgaatctggcggttgatttcacagcggtcagctatcattcctttcttttccatgttttgagcaatatagccttcgtggatggtcggctgttcggtgattccctgatctgcaaagctgcggtgatcaatggatgcatttatctgattgtgggcaagcatttcatttacagtatctgcccagtttgctctccagatacagagttgctcatcactgttccattgttcagaaatgggattctgtctgccatagcggctgctttttggatgcttgtcgatgcggtcatagcctttttcctgtgcgacagatgcggtcatataaactttctttttcccaactttatatctgtattgcttttcccagccatctttttgagcagctttgaattcagtagctgtaaatcctttttcttctccattttttatgcagagatattctttttttgttttatactgccatgttccgttttcgttcagtggacggacggtaagcagaatgtgtgcatgaggattgtgtccatccgtatcgtgaatagcaaagtcagcgcacatgcccatatctacaaagttcttttgaataaaatcttttagaagagaaatattactgtccttatctaattcaacgggaagtgcgacaacaaattcccttgccagtcggctgtcttttgttttttctgcagcttccacagcattccagagttgttcacggtctttccattctggtgaagccatcggtggaagcaatacttcctgataaatgagtccatgctttctggtgtaatcatgctggatgccatcgtaatcattgtacatccggctgcagctcatataagcagaagctgcgacagcggaacgtccggaaccacggctgacaactttggcttgcatatgataaattgccatatctggcacctcctttcgatgttgcctgcaacagcggaaaagccctcggcagagcgcacgagccccgtaggggataccaccgcccgatttatcgggtggtgagtaagtgcgcccttcgggagtagaacttgtgcgtttacattcctcgtagccggattatcagctcccgtttcagggaatccaaatccatttctttaatatggggaacaatactttccaaaatggctccttcctggactaatcggtgtgttctggcatcacgttcttttttgcgatttcttgcttcggcttcttcttggcggtgtcttgcctgtaaaagtgctttttcttccggtgtcatgatttttttatctgccatatctggcacctcctttttatgcccgtatccgggcagtattggttttaaaatcttatggtttggtactatagtttcggataactgacagtggcatgtttctggtgataaataaggaaagaaagtagtaccactgtcagtgaagaataattatcgtgttatgcttctttgcttcagttctggttcggagcatgattgtttaacagaattctttttgcctgttttaaattagctgttgcattgtcctgacgaatattccggttattgatacggacaggaatacatctctccagaatacggtcataaattcgtttgtgtgcgatatcagcggcgttattcagctctgataaagtgagattggtcgttatgatcaggggctttttactgcggtaacgactgtcgatcacattgaatacctgttccagtgcaaagtcagagttccgctcaattccgagatcatcaataatcagaagactgtagcggtttaagctgttgatgaactggtttctgtcttcaaaatgcattccggtaagggtatttagaattcgggaaaagttggtcatcagtacaggaacgcctttttccagaagggcattggcaatgcagcctgcaaaaaaagattttccagtaccgacatcaccccagatgagaagtccggaagcatttgctctcatctcttcccagttgcttacataattgtgtgccagttttatttccggattgatgccgttatccctggcaaaagtgtagtcatagagtgctttgtcctgtaagccgctggttttaagatgctctatttccatttgtttttcatgaagttttctctgggcttcttcctgctcaaagatttcctgctggcatttacagcggatggaaggaataagaacctttccctgtaattcatgcctgcattgccttggcgtattgcatttggaacagtagatcaggtggtctgtttcgttaaaatattcatcagactgaagctctctgtttggggttatagctgttggtttttctataaattttgtcataatgtttcgtattcctcactttcgtaatttcgttgtcgggaagcaggatgatcctgtcttgcccaactgatgatggtagctgcgtggttctgatattgctttccggtagaagccatataaccggataagcgttcaatataatccttccagtcagggattgtctgccggatatcttcaagctctttttctgacagaaaaacattttgaaattttccatagggtgagagtggctccttactccctcttattgctaaattgttcttttttatctctttcttattaccagacagttttctgtctgtatcatggaaagaatcctgtctgtcaataggacagttttttgtctgtcttagggaaagaaatctgtctgtatagtggatggtttcttttgggagttttacataaatccgattgggctgtccgggaccctgccgttttcggaagataagctcctgtttttccagtactgccagagcagttttaaccgtcatctggcttttgtggagaacttctgccagtgcttcaatcgtaaagtaaatgaacacatgaccgtctgtatctgaccacccctcatttttctgggaaagccttgcccggtcgagcaggataatataaagcattttggcagtttcgtttatttccatgtccagaaggaaacggggaaacatcatataagatggcaggttggtgtctgctgtcagaaagtcagtcatgtgttcacctccaatcaaaagggtttattccccaagaaaatcccagtctacatcactatctggctgtgaattttcaggtgctggaaaggatgccctgatttggggctccctttgcgccatgcctgcagtcagtccggaaagaaaaagtggcaatgcctgtttcagactgttttccactgcatctacaatctgtttcacaaaaagttcttcccgttctcttgtttccagataaggatcagcctgtgtgcggtagtagcggtcaaaataatctaccagtgcaagagagattacctgactgtaagatttaaaatcctgcctgtccatcgtctgtaaatattcccaggctctccgttgctgttctttgtccagattaaagcgcaggtttgtgttgcggatattgttctgcatggtttatcccctccttttcaggctcatataagccagagattcgtaacctttggcggtggcgcagatgtcatcaatgatggtgactcgtaatttgtcatacgttccgaagttacggatcagacatccaccgccgccaactacatacaggcgcattaggtcaggattgtattcatatttgcggagtgtggaaaaaagttctgccacatactgtctggcaatagaactgatacaatccatatatggtgctgaaatgtcagctgttccaaaccgcagaatctgttctactgtagattcttcaatcttcactccaaatttgtccagaacagcgttctttgcagcaatcatgcattggtttacaccaagtttttctgtccagcatcggctttcttgtgctttcttattgttgatatacagaatgttcatggttccgtttccgatatctgcaaggagattagttcccttgaaatttccaaggtggtttacaatagccggatatccctgtgggtaaaggctacatcccacaaagcggagatgatattctttgccgttgaaacggaaatggacttctggattctggagcagataggaacgaaaagcttctctttgatttctgatccatgtcagaggaagtccggcagccagatgaacatctgcttcacggatggaaaagacattcagttcccttgcaatagccattagcgtcagaagataatattcttcgtccatagctttatccgggataaattctttgtgtccttcgccgatccggtagtaaatgccgttgtattccagaatattcccggtgaagattggttcagtttcataggctttgatgccggttggggtgacggtgtttgctgttttcatattgccgtagccatgatctacagcaatgattttggtgtttctgagttctcgcataaaaaatacctccgttttcgtattgattgattcagcaggtcgtaccggtgtggtactgctctgctgtgggataagcatacgaaaatcggaggaaaaaggcattgaggggaaattgagcaggaattgagaaaaaagatatattgtgcttacgttcttcatgtactcttgttgtgatttcattgttttttatcgtataatatggatactggaggtggtttggatgaaatacaagattttagttgtcgatgatgataaagaattggtgaaaatgctttgtagttattttaatatgaaacaatatgaaaccattacggctacagatggaatggaagcattaaataaaataaaaatgaaaccggatattattttgttggatatcaatatgccacgcatggatgggattgaagtatgtcgtctgatacgcagtaaagtgttatgtccaattttatttctgacagcaagagttgacgaagatgataaaattaatgggttgctttcaggtggggatgattatattacgaaaccatttagtcttcgggagttggaagcaaggattgtcacaaacataaagagagaagaaaggcatcaacaaaaaacggaataccgtttcatggatgaaatgctgattgattattctgaaaaaatagtagctatagctggacacaggatggagttcacaaaaattgaatatcagattattgaattcttatccatgcatccagggcaggtgtttgataaagaacgtatatatgcacaagtctgtggatatgatgcggaaggggacagtagaacgataacggaattagtacggcgtataaggaaaaaaatagcggattattcagaaaaagaatacatagaaactgtatgggggattggataccgatggaaaaaataagaaacttgtcactgaaaaaaacaattctgctttattttgtgatcagcttaacggcagcatttctgttatctggatttacagttcattttgcaggaaatatgcagaataaaatatgggaaaaatatattgattatgcagattatacggacgtgtttcagcaatatggaaagaaatacgagattgagatatcaagacctaatcaatcgcagatgaatcgtttggactatcatctttcggaaatgtgtgactttatggaaacatattcggtactgattttttcgattgttgggagtgttgttgcggtattctttttttataaaaataagttaaagacacctctacaggaactaaaagatgcctcacaaatgattgcagataatgaactggattttcatgtgtcctatgaaaataaagatgagatgggaactttgtgtaaagaatttgaaatgatgcgaagtgctttagcagataacaacagaaagatgtggcgaatgattgatgacgagaaggctttgcggaatgcaattgcacatgatatacgttctccactttccatattgcgagggtatcaggaaatgctcttagagtttgtttctgctgagagtataaaaacagaggatgttattgatatcttacaaacaggcatgtatcagattgaccgtatagagcatttcacggaaaacatgagaaaaatgtcccatttagaacagagggaactgcaatgctcagagatagaattatcggaactggcaaaaaagattgaggcagaagctgccatgctgtccaagaaggaaagtaaattatgtaaggtagaaagagtgcaggaacaaaacattgtgaaagtggatgaggaacttgtcatggaagtggcagacaacttactggaaaatgaggttcgatatgcacaaaaaagtattgttttgcagataaagaaaaaggatggttttcttataatttctgttgaagatgatggaataggatttgtggatactgaggaaaaagtaacagaaccattttatcataagaatccacaagatgatttaaagcattttggccttggtatgtatatttctcgtattttctgtgaaaagcatggaggaaatttgaaaatatataatgccagacagggcggtgctcatgtagaagctcttttcaaagctgaataaaaatactttataaggctgaaatcacaaataaagtggttttagtcttttttattgtgaatttattgagaattgatttgtatgatgttgttaaagaaataaagaaaggaagagatacaatgaaaacaatcataaaaagaagtatacttgattatttaaagaaccctgttttgtggattggcttgattattatagttgccagtatgtatcaatgtctgtcatcgtatttgcaaattcattatatcaaacagaatgaacagatcacacaaaatgacgtagcattggaagatgctgatgtcatggatgggtacattcccacatctgatgataaagaaagaagaagggagtgggaagatacgatcaaagagacgttaatggacacctccaaaaatggttttggatttagcaggcaggaagcagatcatgtaatgaaagaaattcagaatatggatgtaaagactgcttctgagtttttggaatcccaatatggctattataatgcaatatatgcttatgaggaccttgaaattcataaggggacagcagaagaaatcaatcattatatcgagcggaaattatccgaacattctttttcctggtactttgccaaaaaatttacggattttgcaggattgcatatggccttttttgcaacagtcttgctatcatttttatttattcaggatacacgaaaaagtacctatgaattattacatacaaagcctgttacggcaatccaatatatatgtgggaaagtaataagcggattcattagtatgctgggagtattagtgattttgaatgttatattctttatgctgtgtttgaaaacgtctttagaatcgggctttccggtaacaccaattgatttttgcgtgaattctctgatctatattattccgaatcttttgatgatatgttgtgtctatacaattacagcattaatatttaaaaatccgcttccggcagcaccagttttgtttttacacattatatattcaaatatgctgaccatgaagaatgatatttattatatgagaccgttctctattatggtgcgattccctggcagattttttgaaacacatgtagccaaaatgtcaaacataaatcagattattcttgtaatttcatcagttatattagtatgtatttctgttacaatctggaaaaggaggagggttcattgaaaacggaactaaaaaactgcctgtcgttatataagattttttattcatgtgcatttatactgatattgtgtgctattcatccgattatatactatgaagaaatcggttcagcgattcagtctccgatagcatttttaacaattattttttgtagtgacacatatttgatggaagtaaaaagtaagcgtgccgatgtatttcatttgtatgatcaaaaaaagcagttaaaagtaatatcacagagagtgtgcgttcaaatattatatttattaatactttcctgtgttggatatgttttgtttttctggcaaaaaccgggcagtgtaaacgaaggcgtttcgggcactcagatattccttttattttccattgcaatgttcggaaccatctggctttggagtatatgctctgtgattttgtgtacattgcttggaaatatgtgggcaggtataggatgtttatttggaattgtcattggacttatatcaaaagcgggaagttcatttttcggaaatctgggattgttttctttcagcttttgtgaacctactcaattaatgtccgagagttggatttatggaacgcttgtgtcttttatagtgggtctgcttttatttgcagtattaccaatggctttaaagaaaaggggatagattatgagtattagaataaatgatttaacagttagatttaaaaatggtgtagttgcagtaaataaggcatctcttgaaatacctaagggaatttacggacttttgggagagaatggtgctggaaaaaccactttgatgagggttcttacaactgttttaaaacaaacggaaggaatggtttcccttgatggaattctgtataacgagggaaattatgaaaaaatacagaaaaagattggttatcttccacaggaaatcgacttatatccgaatcttacggtgaaagaatgccttgtatatatgggtggactatcaggagtatccacaaatgacctcaaacaaagaattacctattatttggaaaagacttctcttacagagcatcagaataaaaaaatgcggcaattatctggtggtatgaagagacgtgtcggactcatacaggcacttcttaataatccggattttttgattattgatgaacctaccaccgggttagatccggaagaaagaatcaggatccgcaatcttttggttgatttttcaaaggatagaactgtgctgttttccactcatgtagtagaagatttagcagcaacctgtacacagcttgccattatgaaaaagggaagttttttatattctggaagcgtgagtgggttgctggaaaatgcaaagggctgtgtttggaattgtacggtacaaaatgcagaagaagcccgtttgttagaagccaattattctatatcatctaagcagtatgtagaaaatggaattcatatgaaagtattaagcaaaggaaagccaaatgagaattgtgtcctggataatgatatcactttggaagatgcatatatttatttgacgaatagttgaatataacggcgggcaagttgcccgccgtaaattatgcttattttgttaaaagaccggatagattttttccaatgcaaaatccaatctgtggatataactcctgaatttcctgatattttgcttcaatcatttctggttcatcagcccagatcttttcatatattttgaaagctcttttaaaatgtgttttggcttgcggaagattggcagtcatcagataaatggttccaagggtttcctgaactttggcataatccagacagtcatcggaatggtattccttgatgatgccggataatttttgcaattcagagattcctctttcgggttcctgctgttctgtcaggaacattgcataattggcaatctgaggtatgctgtcatttatatgaagcaggttaaattggtcaagcagtgagatacttttttccatgtgttctcttgcaagatcgggatgaccgttcatgcggtaaagtccaccgagattggcatgaaggttggaaacaaggcgagcattgtcagcagtgatattttctatctgggcaagtgcatccttttccagttttattgctttttctggcttgatttcaagagtagcctgaaaatccagtaacaatgcccggtcagaatcggtgccaatgttttttgtctttaacagccccgttagttcctgaatgattccattcatacctttgtggtagttatagttatccatgtatggaaatgcattttccagaaaaagcagatactttggtatatcatccttttcaatcaattctatgatatttccgattgtttgaaatagctttttgtaataagctacttccattccatgcattaaacatatgtgctgtaaagaatccagtaatatgtggcaacgagttacagatggttttgtctctgaaagggtgatttcctgaatcatcggatgcagagagatagtgcgacgttttgttgtttggacaaaaccagtctcaattaaatcgttgatctcatttagtgtgggcaattccagccatttggcaaatatacgggcagaaataccggtggaaggaagaaagcacatattacacatgatatcctgctgtttaagagataaagtgtataacgaaaacagcgtatggatatgactgtaataggtggctttgctgctttgtccatctttgattattttaattttatcttcgttatggaaagatgctttttccacctgaagtcttgttaataactggtctggagttgagattccattttccagaagttttgctgccagttccacggcaaaagtatgagagtgaacagtttcgatgatcttttcaactgttggccggtacgtgtctgcctctgaataaaatactgatgccagctggaagagagcgttcatatcctctatttcttttaatggcagagtacagtattcatccagtttgcttctggttgtaaacaaaatctgacagcgatattttaatactactgacagaaagctgtcctgtgtggcagtgacattaaaattatctatgataagcagagtatcagatttcagggaacgcagaaaacggttatgtctttgaaaccgttcctggtcagtgctttccggcggatcgtcaataaaatccatgtcagtaatatcctgatgaagattgccggtatattctacataaaggatattggtgtattgctttatgtaccgctttgcgtaggctttggcaagttcactttttccgattccagcaattccgcaaagaaaaatatgacggttttcctcaagcatggtatataattcttccagttctttatctcttccgataaaatgacggcatggtttcggaacctcactgtccataatataatccagcacaatgggggataaagctcctccggcgagtagcttctgatttttggtattacgtttgatgaattggcgttccatgccaaaagaaatcagttttgcaagaaacagcagtcttgaactggctggtttatataagggagtcagatttttctttttcgcatctgagatgctgtcatcctgaatgaataaagtgtaaatatcttgtatagccatattacagtcagacatcagtggaagaagattctggtggatggtatgggctaacttttcctgattggatggcttggaatagtaagcggatattttaggactgattttagcctgaccagtcatccagcggcaaaccagaccgttatccattgaaaaatcctgatttgccggatcatccataaaatcttcaaataattcgtataaaaaatcaggctgactcatttgattactttcgctgatatgattttttaagcaagtgctaatagaagaaaaatcgcatcgattcaatagaaattcccctttcgtagttaagattgagtatatctatcatagcacgaacatacattcgattcaagaaaatgcggatatttttaaagtgattgtgtcaatttacaatcaatttctattcaatgtggttttcaggcaggttctgtaaaataagctcagaacaaacaataacgggaggagcttatgcaacagaatattgaatttgagcggtgcattgattttctggtacggatgattgataagtacggcgaagaagtcctccgggagttggaggaagaaaaacagaataaggaagaaaaagaagcggcagtttcctgaaatacaaaatgtaaatcagactgtcgctttttcatgtacttttaaatcaaataaattttaaaagctgatgcagagtgtgtggctcattattctgagaaacggtaatacgagtatcaaatggcttgaaatgattctgcgtataaaagctcagaagaaattcattatcttcgcattcaagaaactccataacgccacctacggaatatttgagactggatatggtttccagtgcaaatcccagtagaatatttccaggaattcgtttttcctttggaagagaatagttctttcccaactgggcgatcaggtaagctgcggtagtataggattgtgtttcttcatccaaaatactgacacgggacagcttttttgccattgtcttgctgatatttgaagcacggacagagatgggttttactgtaagtgaaaaataaccaaccagtgaagcatcttcagcatcaaataccagataagtgatagattgatcttttttggtaaactcaatcgcattatgtaataaaaagtattccacatcgggatttttgggacaagaaaaatcggagagtaagtcgtaaagactttcctctccgatatatgtcggttcgtctttatccaaatatgcccgaatattaacggtaaaatatttatcagacatgttttttcttcctttttgacattaaagctaagatttcctgtgggttcgttaactgacgtccgggaagtgtctgctttggtgtgcggtcacggtcagcttcgtcaattgctgcgacaaaacgctttacgctatttggattggatacgacaaaattatgagtaatacttgaagtagccatactaacacctcctcttttttggcttttttgtgtatttatagtatatgcaatgtgtgataaaaacacaatatcaaaaacagaaattatttctaaataattttcaagccggacatttattagacgcttccggtaggcgaacaatattttcgagccaatcatttataagtcgccaatggtgggcgggcaatattttgataacagaaatgctctgtatctaacttaattatacgattggcgaagaaatgcgtcaatacggaaaataagtattgaaaatagttggaacaagtactaaaattaagttgggacattgaatggaagttatgttacgagataataagaattgtaggtggaaggtttgaacatagaagcatatgatgctgattcattgagaaaaatggttaggttgcttgaatatgagaacaagatattaaaagataaattgaagaaagcaggcattttatatgaagaggtgaatccttttgaagaaaaaatagaaagtgcagaagaatatgacctggatcaagggagtcgtattgtaaatccgccatatattacagagaaaatggcaatacgtttcttttcgatgttttggggaagagaagatgtatatgccagacggggaaagaacgggggttattttccacaatgtgcaaatcgttggaatgaccggctttgtcctaaacaacgtaaagagaaggtattttgtgatgaatgtgaaaataccaaatggataagtctggatgtaaaaaaaataattgctcatttgttaggcacaaaagaagatggatcagatgtaataggtgtatatcctttactgccaaatggaacatgcagatttattgtatttgattttgataatcacgaaaaaggagcagaggttacggactttgcaaatacggataatgagtggcataaagaagtggatgcgcttagaaaaatgtgtgagcttaatggtatcagacctttagttgagagatctcgatctggaaaaggtgcccatgtatggattttctttaaaaaggcaatacctgcggcaacagcaaggaattttggatttctcctgttagacaagggttcaacttccatcaatctgaaatcttttcattattatgatagaatgtatccttcgcaggatgtggcaagcagcataggtaatttgattgcattgccattacaggggcaggcacttaaaaatggaaatagtgcttttgtagatgaaaattggaatgcatatcctgatcaatgggatgctcttttcaataaaacaaaaaagctgggaatagaagatgttgaacaatgcatggcaaaatggcagggagaattagcagaagtcagaggaacgcttactaatattgagaagaatgtcagaccgaaaccatggaagaagaaatgtgagttttgtaagtcagatgttgtgggcaagcttcatatggtattgggcaatggagtttatattgatactctgaatcttatgccaagaatacaaaatcaggtccgtagtttggcggcatttgataatccggaattttacaaaaataaaaggctgggatattctaattattataatttcagtgctgtatatttaggtaaggatatagatggatatatacagattccgagaggactgcgggaaaatattatacaggaatgtgaaaaagcaggcatttcagttgatgtttcagatcaaagagaaacaggacaacctatcagagtatcttttaaaggtgatttgcgaatgcaacaggaattagcagcagaaaaattattatcacattcagatggggttttgagtgcggcaactgcatttggaaagactgtagtatgtagttaccttattgcagagcgaaaagtaaatacgctcattttgctgcaaagtaaagatttgcttaatcagtgggttgatgaattgaatcatttcttagagataagagaagaaccaccggaatatgaaacaaaaacaggaagaaagaaaaaaagaaatagtgtgataggcgttttgcacggaaataaaaatacattgacagggattatagatgttgcaatggttggttcaatgtacagcagaggaaaatttaatgaacggattaattcttacggaatggtaattatggatgaatgtcatcacgcagcttctaacacatctatggaattattgcagaaaataaatgcaaaatacgtatatggtgtttctgctacacctaaacgtggtgacagtcttgatcggatcatctatatgctgttaggacctttgagacatagatttactgcattggagagggctaaggaacaggggattggacattattttgtcccaagatacacaagagtagttgatactgcagaaagcaaggataatattaataaagcatataatttgattagtaccagtaaggtgcgcaatgaaatgatcatagatgatgttataacttgtgttgcaagaaaacaaactcctgtaattttgacaagatttaaggaacatgcaaaatttttacatgatgccttaaaggaaaaagcagatcatgtattccttctgtatggggataattcggataaggaaaatgctgaaataagagtaaaattaaagcagatacctgaaaatgaatcgcttattttggtggcaactggtcagaaaataggagaagggtttgatttcccaagactggatgtattaatgcttgcagcacctgtatcttttgaaggacgcctggaacagtatgtaggtagattaaacagagattatgtcggaaaagaagccgtttatgtgtatgattatatcgattcgcatgtgcgttattttgataaaatgtatgcaaaaagattgagaacatataggaaaatgggattttcaatctggacgcaagagttgcaacctaaacaaataataaatgcaatatttgattctgtaaattataccgaaaaattcgagcaagatattgtagagtcagaaaaaatggcggtaatttccagtccggatatcagacaggataaaattgacagatttttattactagtcaagaagagacaggaagtaggggtaaaggtcacagttattacaacagatccggaagatattacttacggaaagtcagatgtatgttatgaattaatcagagcaatgcaattggtaggaataaatgtgataacaagaacagaagtagaagaatgttttgccgttattgatgatgaaatagtatggcatggcgggatgaatctacttggaaaagctgatgtctgggataacttaatgcgtatcagaaattcacaagttgcaacggaattgttggaaattgctttgggatgttctgaggagaggaggaaaagtgaataaaaagataaaatgtgatatctataccagagtatccacaaccatgcaggtagatggctacagtctggatgctcagaaagaaaaactcaagagatatgcggaatttcagaacatggaaatcgtaaatgagtattccgatgaaggtaaatctggaaagagcgtagagggcagaccggaatttcagagaatgttggataatattgagaatggaacagatgaggtgcagtttgtactggtgttcaagctttccagatttggtcgtaatgcggcagatgttttaaattctttgcagaggatgcaggattttggagtgaatctgatctgtgtagaagatggaattgacagctcaaaagatagtggaaagctgatgatttctgttctgtctgcggtggcagagatcgaacgagagaatatccttgttcagacaatggaaggacgtaagcagaaagccagggaaggaaaatggaatggtggatttgctccgtatggttatgaattagtaaatggagaattgcagattgcagaggacgaagcagagattattcgtctgatctatgacaaatttattcataccaatatgggaatctctgcgattgctgcatggctgaaccagcatggatacaaaaagaaaaaacgacagaataatacactggacgcatttgccgcttcatttataaagggcgttctggataatccggtatactgtggaaagctggcttatggacgaaggaaaaacgagaaagtttctggtacaagaaatgaataccgcattgtaaagcaggaaaattatatgctgcacgatggtatccatgaagggattgtttcagaaacagactgggagctggcacatcaaaaacgggaaaaaacaggtgtgaaatatgaaaagacacatagtctggatcatgagcatattttatccggaatattgagatgtccgttatgtggaagcgatatgtatggaaacgtgaaccgaaagaaaaagaaagacggaaccttatataaggattatttctattatgcctgcaaacatcgtcgcctggtagatggtcataaatgtggatatcgtaaacaatggagcgaggagaagattaacaatgcagtggaagaaattattcggaagctggtgaagaatccgaaatttgaagaagcaattctgaataaaatcggttcaagaatagatacagaagaaatagaaaaagagattgaaagactggaaaaacagcacaggcagctgactggagcaaaagcaagacttggacagcagatggacagcctggacatcatggataaattttataaaaagaaatatcaggatatggagacaaggttataccgtttgtatgatgagattgaagacgtggagaacagtatagaagaagtcaagaaccgcctgttgaatatccggcaacagaaaatatcagaagaaaacgtctatcaatttcttttatattttgataaactatatgataagttcaccgacctggagaagaaagaatttcttaacagttttgtagaacaggtggacatttacgagcaggagcagccagatggcagattcctgaagcacataaagttccgttttccggtgtattttggaggcagggaaacacaggaactttgttgggacaacgaaagtaccgttgagactgtggtgttgctacaaaggaaaaatatgtagaaatccttgaatttacgcactttgtggagtttttcagtttcagaaaaataggtgaaaatcacaaagaaaagagccttgtgaagaaagtaaccgttgttgttgcgttagacctcgagacggggaacacaaagaatcttgaatatgaaaatgaatagagagctatcagattattgatagattatagggatacttgtcaaaagcgggtgtccctattttttatagggcattccagaaatggagtgtcttttttataccaaaatattaaaaattcaggaggaaaacgaaaatgacaaacacagcgttaagagcagagaatagcaattctcgcacaattactttcaagagtagggaacacgaaaaattttatgaggaatatctgaaaaaatgcagatatcaggatgtctaccatcgggctttgatttattgcctgggtatcgacagagacacaagagataatgtgaataaaatctataattttaaaactggatgtgtaaaaacggaatgcctgcaggaagggtggcagaccagtggaagtttacgaattgtccgtatggcatttaacctgtattgtaatggaacaccaagcgtcggagattacgaagcagaagaagatcagttgaaagaatgtcagtgttataccgtagaggatctgttttgctgtggatatgcccggtatttctgggaagctattaaaatccgttatccagagtattgcttttacaaagactgggaggatatatatgctgaaaattagattacagggtactttgagggacattcaatggtttcgacgtattttggaaaatcataaggaattggatgtcctggaagtatctgatgcttatgcaaataaaggaacaagtaaatattttcgtgtttatgtagaagtagaagaaaaacagtaaatcggaggaaggtatatgtgtaaagtaattgctattgcaaatcagaagggcggagtagccaaaacaacgacaaccatcaatctgggagccggactgacaaagaatgggaaaaaagtagtgctggtagatgcagatccgcagggacatctgacaatgggaatgggatttcccaaaaatctcaaagtgactttaaagagtatgatggaaaatatcatcatgggactggagtttgatccaaaggaagcagtcttgcaccatgaagaagggatggatctgattccgtccaataaattgcttgccggaatggatatgtccttatttactgttgaggatagggaaaaagtactgaaagagtatctggaactattgaaagatgaatatgattatattctgattgactgtatgccatcattgggaatgttgacaatcaatgcgttgagtgcagcggacagcgttctgattccggtacagccacaatattatgcggcggatggacttatggaattactgaaagtggtaaaaggaatccatcagaggtttaatccggaattgcagatagaaggtattttgttcacaatggataattgccgttacaataatgcaaagagaaacaaacaggcaattaaaactacatatggaaatgacattaagatttttgagcagacgattccgagaacggaaagtcttgcagaaacagcatctgaaggtgtaagtatatttgcttatgatggaaaaagcaaaggggcagacagttacagagaactggttcaggaggtgttgaaacatgcgtagaccgaaaaaagagattcagcttacctcttatgatgagttactgggattagaagaatcaccggaaaagagtatgaaccaggttgtggaaatagaactggaaaagctctatcctttcaaaaatcatccatttcatgtaagcgatgatgaaaaaatggctgagacagtagagagtattaaaaactacggtgttttaaatcctgctctggtaagaccccgatcagaaggtggatatgaactgatttcaggtcacaggagaaaaagaggctgtgaactgtgtggcaaaacaactatgccggtccttgtccgaaactatacagatgatgaagctgtcataattatggtcgattccaacattcagcgtgaaaatattctgccaagtgaaaaggcccatgcctataagatgaaatatgatgctatgaagcaccagggaagtaaaggtgaaaaatatacggcagatatggttggtgaaacagccggggacagtggaagaactgtgcagagatatatccgtctggcttcattatcagatggattattggaatatgtggacgataataaaatccctatgatagtgggagaaaaattgtcttatctgaaaccacaggaacaggaatggcttctggaaggaattgtcaacagtaatatctttccgacaaaacaacaggcagaacaattaaaggaatgcagtgcaaatggaaaattaaatcagggttatatctatgccgttttattgaaaaaagaaaacagtaaaatcaatgtaaccattccggcaaaaagaatcggcaattattttccagagacatattctaaagaacagatagaagaagttatttttatgcttttggataaatggaaacaaaacagagaaggagtagcagatgcagaagatacagtttgattattttacgggaatggaagcggaacaatatagcttttatcgtgtcccgaaagtgctgtttacagaaccatgctttaaagctctttcttgtgaagcaaaggtattatacggtctgatgctggaccgtatgagcctgagcattaagaaccgatggctggattcagaggacagagtatatattattttcacggtggaagaaattgcagagctgatgaactgtggaacccaaaaggcagtgaagctggtaaaagagttggacagtaataatgggattggactgattgaaaagaaacgtctgggtctgggaaagcctaatgttatttatgtgaaaaattttatgctcagagaagtgccagaccaaaagccgatggatagctgtgcagatttgcaatcagagcagaaaaattatagaaaatgtgcagatctgcaatctgagcagggaaaccatgaagagtgtgcaaatctgcaatcagaagctgagaatagggaaaaaacaggcacttttctgaattgtgaaaatcatcattcaggagtagtgaaatccacaattcaggattgtgtggaatcacaattacagaatggtgaaaatcacaattcaggaatgatgaaaaccacaaatcaagaatttccagaatcacaattccaaaattgtgaaaatcatcattcaagaatagtggaaatcacaaaaccagaatatccgaaatcacaatctaataatactgatattaacaagactgatattagtgaaactgagataaatcaatcctatccaatcatatcaggcaatctgaaaaagaaaagagatgtgatggaggagatgcgggcatatcgtgaagtgattcatgaaaacatagattatcaatatcatgccaaagaagatgtggatgaactggtagaactgatgattgaagttatgatgatgccggaggacagtatgattcggatcgcagggacagaaaagccagttgctttggtgaaaagcaggtttatgaagctgaattattcacatatcgaatatgtgctgttttgtctgaatcgaaatacgaccaaggttggaaacattaaagcatatcttttgactgccctgtataatgccccggcaacgataaacagctattatcaggcagaggttaatcacgatatgtatggaggataaaggaacatgagaaatatgataaaaaaagttattgttccagcactggtgattgttgtattgtttgcagtgctgagaccgctttgtatccaggatgggaagtgcaattatttattgctgttgctactgatggggataccattcggaattggaaaaatgtgtgtctggatggttccaagagggtttgaccttggaggaacactggcagtatggataatgaattttctgatcggaggattgataggaagtgtcgttcttctggcaatggttggacaggcaatcatttatcttagtgttttcttgctcacagttattacaggaatacataaaataccgagaataaaatgaaatagatcttttgaaaagcagctaagacaaaattagctgctttttttctggaaactttgcgacacaatgtcgtaaagctgggataaattgcaggaaaggagacaccgtattgagcaatcgtgcaatttccacagaacttattgaattgggagaacggatcagaaaacgcaggcaggaaatgaagttgtcacaggaatcttttgcggaaaaagcaggtatcagtgtcaatacggtcagcaggatagaaggagggcaaacggcaatgtctgttgagattttcaggaagatgattgagatcctggaaacagatgccaatatcctgatgggaaaagagagggacgatgcagaaaaaagaaagcagtttgaggaagtattttatcgtattcagaagatggaatggaaagagcagaaaattatcatgcagacaatagattcactgatagaaagttttaatgagtacaggtgaaatttcaccatatatggggtgtaaaacaaaaaaactccccatatatgctaaggataatagttttttgtgctgttaaaatagcaaacagagagaaagagacagaaacaaggaagggagacaggattgatgaccagacaagaaaatttaatctatcggaagcagtgtccctatgatgcaatgggagactattctgttttgatggaaaatgaaaagaacataaaaacagaaagaaatgcaaagaagtctgaccgggacatcagacggaaaataaaatagaggctgctgtaaattagcagaaagggcagtaaggaagtttcaggctctcgttaaaaaaaacgggtgtgccggaagctgttttttactgcccttttgccagtagatcagtaataatcctatcctttctgctgatgggcacctgttgccagcaggcagaagggtggtaatcatgctgacattgcaggaattgaaacaggttgtaggtaacagggaagaaagaagaaaggttccatccgccaggtatttaagagaaaacgatgtggcagttgtaaagcatagactgatagatggtgcggaaattattgcgtatcagacaggatatgttttctattgtgcaggtgattatggaacggttttttctttatttacctgtcgagattatgtatatgaagcaggaagaaaaataatagttgttaaggaagatttttttgataatcagccctggtatgtgcggttgatattagaaggtgaagatcggctgtgcaggaacagggaggtacgagaacataataattgcatttcatatagccatatttcagaaggctggtgtgaattggtggacaaaaggcagaatgtacttgaaaaactgattatagaagaagttattggagaattcatggatctgctgactgaccggcagagacaggtgatccatcaaatttattttcagcaacggacacaaagagaagtgtcacgggtgtttggaattacagaaccggcagtatcaaaatgtatttcacaggcaaagcagaaaatgagaagaaatgcaggcagactgatcggagtgcttcagaagggagaataaaagatgcgtggtaaaaaaccaaaggaaagacaacggtatgtgctgcgtgtaaatgaaactctcgtagaagttaccagagacgtatatctggcatggtaccagtcaagaagaaaagaaagataccagcttgaaaaaatgcagaaaaatggtgtatgcggaatagaaaaagtaggagaaacgagttacaacagttatttgcatatattatcaccagaagaaatagtcatcagggtgtcagaaatacaagagctgcaggaagcactgaaatatttgtctgaagaagaaatggaattgataagactattattttttgaagagtacacagttaaaaaaacagcacagtatttcgggtgttgtacaaagacaatcagaaacaggaaaaacaaagtattgcagaaactaaaagacaggctggaaactttgtaaatttttgctgtttcaaaaaattttctaaaaaaatttcaaacaggttaatttttgccctttcacacatgcggttagtggaggggcaaatgtctattttaattcaaaacaataaattccctcctaaaagtgaaccttgacaatttcatatcagcagcaagaggatacctgaatttcccagctacgcatctggcggcgggtattcggtggcaacgtgaagggcaatggatgagaggcacccttggcaggaatgattacgaattacctcttgcggcttaatagctcaatcctgtttttatttaaaagtcaatccaagacacaagggaggtggtttatatgattgattcatgcaggtgtaagcctgaacgaaagtggagtaaattatcgaagaaagagaggactcagtcaaaatgaaaatgcgatttaaaagattcttgtcgggatttatggcagttgcaactttggcgtctgttatcgttcaaccagtcacggtttctgcttctgaattagaaccggagacaacttcatttgaacagcaatatccggaactgcagtatgtgcaggatactcttgatgaagatgaaattgtgaaagcaaaggatattgagattccctatggagaagaatttgaagtggaagtcgatctgtccggtatagagggcgtgaatgaaaaaaaggtgaaagttttattccatgaagcaaagagtgaagccggtacagattttgacgcacatacaccggatacctacaaagctgtctatgcagtagagccagtcagcggtcacccagcttacagagtaagcagaaacattacggtaaaagagccggaaacagaagcacagacaaagagttcttctgaaaatacagctggtgaaggaaatgccggtgaaacagaagattccggtaatgcggatgaagatgctgattcggacgggtcaaaagaaattgtaactgatcttacagatgagcaggaagtgacgacagatgaagaatccggtctggctgtttcagaagtaatggatcaggcagcggagaacggtatcgacctttattctatggaagaaggagaagcggttactttcatggcaacagacattgcaacacagagtaccaagaaagttacagtaacaagaggaacctgttatcagtattcggattacgggtatggaagttatctgacttacaaatatacggttcagtttggtaatgtttctgcaacagcatattgcgtggagccttctaaatccagtccgggaagtggtacttatgatattacaaagctcagtgatggtaagaagctggcaaaggtttgttactatggcacaaaggcttccggtgatgaaggatttttcacagaggaaaatggatatggaaacctaagtgcaggtgccagatttattctggtacatctggcagcatcttatgctaatggtggagattctgccttttccggtgcaagcggtacagcaaagacacttgcaatgaaactgtataattactgtatttcacagccggagattccagatgtagatatgagtttttctgatgcagatgtgacagcctatgtagatggcaacagccagagaacaaaggaaatcatttttaaagcagatgaactgcagagtatcacaatgaaacttccaagtggtgtgaaacttcacaacgtgacaaccggaaagacaagcaaagctggtgaagcagtggaaatcagtggtggaaccaagttttacttatctgcacctcttacacaggtacaggatgtcgcaggaagctggtcggcaacgatgaaaggcagtgtaacaaaagattattctgcatataagatcagtaccggatctggttcacaggacctggccctggtatttggtgaaggtgttgatgatgagaaatatgtggacttcaaagtaacctgggtgcagcacgcaagtgtgaaggtgattaaaaaagatgcaaaagcagacgcaaagctgtctggtgcagtgtttggtttatacagtgatgcaaactgtacaaagctgatcacaaagttaccggcaaccgatgcgaacggggaatcgtccgtacagatcattaagacacaggacactgtatatctgaaagagattacagctccgacaggataccgtatcaatgcaactgcctacaatgtaaaactggaagtcagcaaaacaacgactgtgactgttccggatgaagaacagatgggacagctgactgtttataaagaaggtcaggttctgacaggtgcagatgtcaccgagaatggaacaacatttaagtatgagaaacgcagacagaaaggtgcgatttatgatgtgtatgccggagcagatattaaaactgcttatggtgccaaggtttacagcaagggtgatctggtcaaagagaatctgacaacagactcgaatggggcagtcattctgaaaaacctgcatcttggtacatatatcatcaaagaaaaacaggctccgaccggattttataatgccggggaagaaaagtcagtcactctttcttatgcaggacagaatgtagatgttgttttttctgagacaacttttacgaatgacagacagaaagcagaagtagttgtgacaaagcaggataaggatacagaaaatcctctggatggaggaatttttggactttatgcagccagtgacattaaaaatgcagatggaacggttgttgtaaagaaaggcactctgattgagaaagtgacaactggaaatgatggaacggcgaagtttaccgcagatctgccgctgggattttcctatgatgtaaaggaagtacaggctccggaaggctatctgagaaatgcggatgatatctatacgtttactttttcttatacaaacgataaggaagcgaaactgacatttaagcataccttcaaaaacgagcgtgtgacagcaaagatttccttacagaagcaggacaaagaaacaaagaaggctgttccacagggagatgctactttagaaaaggcagtctatggactatatgcccgtgaggatattgtccatccggatggagcaactggtgtgatctacgaagcgggtgagcaggttgccactcttacaacagataagaatggacaggcttctgtagatggattatatcttggcaattactatgtaaaagagattactcctccaacgggttacctggcagatgaagaagaacatgatctggtctgcaactatgagggtgattttgtagcggaagtaaaacgtgactgtctgtctctggaacaggtaatgaagcagccatttgaaatcatcaaggcagcgaacaacggaaagacagatgccgatttactgaaaggtgcaggatttaccgcttatctggtatcttccctgacagtaaaagaagatggcagctatgactttggttctgccaagccggtagtgatcggggaaaatggtgcaacagagatctttacagatgagaaagggtatgcccgcagtattgcgattccgtatggaacttacatcgtccgtgaaacaaccacaccacataattacactccggtcaatgatttcatcgtacagattacagagaatcatccgactacaccgcaggtatggagggtgctgcttgacaaagagtttgaagcgaagctgaagattatcaaacaggacgatgagacaaagaaagcagtccttcagaaaaatacggagtttaagatttttaacctggatacagaaaagtatgtggagcaggtaacaacgtatccgacgacggtaaaacacaaatcttattttacagatgagcagggatacttaatccttccacagaatctgaagattggacattaccgtattgaggaagtgaacgcaccttatggatatacgctcaatgagaattactatgaggtagatgtagattccaatacagcatatcagatggacggaacttccggcgatgtgatcattgagatcgcatacgagaatcatccggttaagggagaactgaacatcgtaaaacagggtgaggtcttaaatggttataaagatgactttacttatcagaaagaaactctggagggagcagtctttgaggtatatgctgccgaagatatttatacagcagatttccagaaagatgataatggaaaccgtatcctggagtatgcttctggggaactggtaggaactgttaccacggataaggatggaaaggcacagatcgctgaccttccacttggaacctataagattgttgaaaagacagcaccagagggctttgtgttaaatgaagaagcacagacagtaacatttgaatacaaagaccagaaaacaccagttattgagcagacagcaacctttgagaatgaccgccagaaagtggaagtgtccgtagtcaaacaggatgcagagacaaaaacggttgtggcgggtgcagagtttggtatctatgcaaaagaagatattctggcacatgaagaagtgattgtgaaggcagataccttacttggaaaagcagtcagtggggaagatggaaaggcagtatttgacgttgaccttccatttagtacttactatatcaaagaacttgcagctccggcagggtatgtctcttcttttgagactttggaagtgactgccaaatatcagggacaggatgtgaaaatggtagagctggaatctgtatttaagaaccagccgacaaaagtaacctttacgaagtccgatattacgacaggcgtggaactttccggggcaacgcttacggtgcttgataaggatggaaatgtggtagatacatggaagtctgtaaagggtgaggaacacttgattgaaagactcacagcccgggagacatatactcttcgtgaagaaatggctccttatggctatctgatggcggaagaagtttcctttactgtggacgatactgctgaaatccagaaggtagagatgaaagatgcagtgccaaccggaacacttatcatcaataaaaaaggtgagttcctggagaaaatatctgcactggattccattggcggatggatgaagcatctgtttgaatatctttccggttccctgaaagacgttacttttgaggtttatgccttagaagatataaaagcggcggatggtgagagtgaagattactacaaaaaggatgcactgatagcaacgatcacgacggatgaaacaggagtggcgaaactgacagaccttcctcttggcaaatactgtgtcaaagagaaagagacagcaaatggatatgtcctggatggagaagctcgtgaagtggatctgacttaccgtgaccagaataccgcagttgttacttattctgctgactggcagaacaaacgccagagagcagaagtaaacgtgttaaagaaagaaaaagattccgaccgtgtactggaaggggctgtatttgccctgtgcaataaagaaaatattgtcaatgcaaagggcgatgtgatcttgaaagcggatacggttattgaggagcaggctacggataaggaaggaaaactgacctttacggcagatctgccacttggctatacctactatgtgaaagaaacttctccggcaccgggatttgcgacaacagaccaggtacaggaatttacttttgaatatggtggggcagataaggaaacactgtcttatgtgtttacttttgaagatgagccgacaaccgtagagtttaccaaaacatccctgacagacggaaaggagattgagggagcaaaactgaaagttacagatgagagtggaaacactgtggatgaatggacttctggtaaagaaccacatatcatcaaagaactgaccgctggcaagaagtacaccatgacagaaacacttcctgcggacggttatgtgacagcagagagcatcacttttacggtggaagataccggtgaagtacagaaggtggaaatgaaggatgatgtgacaaaagtgcagatttccaagaccgatatttccggtaaggagctgccaggagcgaaactgacgatccttgataaagatggaaagaccgtagaaagctggacatctgagaaaaaaccacactatattgagatgcttccaatcggggaatatatcctccgtgaagaaactgcaccggatggttatctggttgcagaagatgtgaagtttacggtcaaagatactggagaaatccagaaggttgtgatgaaggatgaggcgaaaccagaggaaactccaacagagacaccgacggaaacaccagaaaccacaccaacaccggagacaaaaaccacagaagaaacaaagaaatcgacttcaccaaagacaggagataatacaccgattctgttctggattctgcttgcaggggctggaatggctggtcttggtggaacagtgattcttcgcaaaaagaagaaataagagatcataagatttcttagtaatggatgagggcatttatggacacaggattcatagatgcccttttataaaatttcaaaagaattagggagaaaagaagatgacaaaaacagtattgatcgttgctgcagctgcagtatttctggtatatggatttgtcctttggtgctgtatcaaagtgggggcagaatcagaaaaagaatatatgaaactggcagaaaagagaggaaaggagtagcaatgtgataaatgaggataagacagcagtgaaagaagaaagggcgtggtgtgattgcaggatgaagtgaatgagaaaacagtctcactttgtatccgctgcggcaaggtcactgccaacttgctgaaagctgccatggtaaaggctcttgcaaagatggagcaggagaaaaaacagcagggacagaaacagccccagaaggaaaaggaggataagacctataagggaaaacagagtcttgataagctgatgaagcagaatgtacagctgtccaacattgagatcacagatggaaacatcaagtcttttgaacgggtagcaaaaaagtacagcattgatttcagtctgaaaaaagatgtgactgctgacccgccaagatattatgtgttctttaaggcaagagatgccgatgtgatgactgccgcttttaaggaatatacaggacagacgttgaataaggacaaaaaaccatctgtgaggaagaagttacagcaggcaatcaccaaatcgcttgcaaagcacagagaactggagaaaacaaaaggaaaggagaaggagccgtcattatgagcagattacagaaattgcttggtgtaggaaaaggatacctggagaggttaccgccggtggatgtacataagctgcttcggattgttctgatgaatcttccgtatatcgtgatcttttatgtgggaaataagctggcatggttatatcaatactgtgtgggtgattccatgatagaaagactgatggtactggtcttaaatttccagatggcattcagcaggattcttccaagtatgcataaaaatgaattgctggttgggattacaggagccgtggcggtgaagctcttggtctatatgaaagggaaaaatgccaaaaagttccggcagggagtggagtatggttcggcaagatgggggacggcaaaagacattgcaccctttatcgacccggtatttgagaacaatatcctgctgaccatgacggaacggctgaccatgaatggcagaccaaagaatccgaaatttgcgaggaacaagaacgtgattgtgattggcggatctggctcaggaaagacacgtttttatgtaaaacccaacttgatgcagatgggaaaatacatcagttatgtggtcacggacccgaaagggacgatcatcattgagtgcggaaagatgctggtacggcatggatataaagtgaaagtattgaatacgattaatttttccaagagtatgcactataaccccttccactatatccattcagaaaaggatattttgaaactggtaaatacgattatggtgaacacgaaaggggaaggcgagaagtccagtgaggatttctggacgagtgcgactcgttcgcagacggtaaaaagtctgcgcacgagcaacggttttccgttgttcggagaactggtagtttgataggtggaatgacggggtaacgccctgaaacgcctacccttgatgggcgtgcattagctgtaatggctggtgtacgaagccccatgacaaaggctgagagtaaccgtaaccactgcctaaagtggtcgaaagcggtctggaggcagactgtgttacctataagccgagagtctataagatacctatggttagaatgttcgctttggcgggcggactgacgaacctgcgaatgtacaggtctaaaagaagaccacgcagaaatgtgtgggtgcgttaatgcgcagtcggtgtggtttagtagaaattgatcctacgaacgaccatgctgtgttacaggcacaggcaagccgacaggtctatagcaggaacctacgggtatgtatgaacagatagaactatcggaacgaggaaaggcagcagattccgcaaggaatagtctgacgaaaaacaataagcagacgaactgctgctgaaaagtagtggtcgaacctatgatgtgcttgcgttatgtgagctacggaggaatggccacaagtcgattgagataagcaggcattattcaatccaacataaggattcgagtaagaccaaaagggtcactttcgcaaaaaggaggtgatgccttatgccaaagaaaaacaaaactctatgtgtagatgacttacgtcatgccgagtattacggtatgcagccagtttttgatgaactctatcatcgaagtttggagggagaaaattttaccgaccttatggatttaattctgagccgggacaacattcttctggcatatcggaacatcaaagcaaacggaggaagctacacagcaggaacagacaacaaaaacatcagtgacatcgggtgtttaccgcccgaaacagttgcagagaaagtgaggtttattgtcacaggaagtcagcacggataccgcccaaagccggtaagacgcaaagacattccgaaaccaaacggaaaaaccagaccgttaggtattccctgtatctgggacaggctggtacagcaatgtatcaaacaggtcatagagccaatctgcgaagcgaaattcagcgacaacagttacggctttcgcccgaaccgttccgtggaacacgccgtgcagaaaacttacaccatgcttcaacgcatgaacctgcattatgtgattgagtttgatataaaaggatttttcgacaacgtaaatcacagcaagctaatgcggcaaatatgggcaatgggaatacacgacaagcagttgatttttattatcaagcggattctgaaagcaccgattagaatgccagacggcactacactcattccagacaaaggcactccgcaaggcggtatcatttcaccgttgcttgccaatatcgtgctgaatgaactggacaaatgggttgagagccaatggcagaaccaccctcttgtaaaggaatacgggtatgagaggaaaatcagaaactcgattacttttgaccggagcaaggcattcctcaaaatgaggaaaacagggttgaaagaaatgtatatcgtgagatatgcagatgatttcagaattttctgccggaataaagaggacgctttgagaacgaaagaggctgtaacggcatggataaccgagaggctgaggttggaggtatcgccagagaaaacaaggatagtcaatgttagaaaacgctattcagagtttcttgggtttaagatacgagtcagaccgaaaaacaggaagtacatcgtgcaatctcatatctgtgacaaaaagttggaactggaaaggcaaaaactggtggaacaggcgaaacgaattgcccgaccttcagagggaaaaagacctttggacgaaatacggctgtacaattcaatggttctgggaatacagaattattttcaacttgccacctgcatcagcattgattgcaggaaaatccacagacaggtcatgacagttttaacaaatcggctcaatacagaaaccgggtgcagacttgttcgagagggcggcgcaatgaccgagagcgaaaaagaacggtttggaaagtcggcaatgatacggtatgtatctggaatcgaccaacctatctaccctatcgcatacatcaagaacaagataccgatggcaaagaaagcggcggtttgcagttacacggtagagggacgggcattgatacacacgaacctaagtatgaactcatctgttctatcaggtttgaggaatcaaccgtctatggggcgaagcacagaacttactgacagcaggatttcactattctcggctcaacgtggaaaatgtgcgctaagtggggaactctttgaaaatgcggctgacatagtatgctggctgaaaacaccggcagaattgggcggcaaggaacgctatcgaaatatgattttgttccataatagatttcttccactcctgcaagagtgtcctaagaatgagctaaaagagatagccgacacgctcaaggcaacaaaggaactgatgttaaaagtgaacagtctgcgccagcaggctggtttgtccgcaatagaaaactaacatttcatttggtgattgattaaatgcttgtgaaaacaaccgatggaacgccggatgcggtgaaagtcgcacgtccggtgtggagtgggggaaaatccggcgataacttcaaaggattacctatcactataagcagagaggcttctgtactgtgccctgatcggctatatctggtatgaagcaccggaagaagaacagaactttgcgaccctgcttgagtttatcaacgcttcggaaacaagggaagatgatgagacatttaaaaatgcagtagatatgctgtttgaggaactggaaaaggaagaaccggagcattttgcagtacgtcagtataagaaatataaactggcggcaggaaaaacagcaaagagtattttgatttcctgtggtgcaaggcttgcaccgtttgacattgcagagcttcgtgagatcatgagctatgatgagatggaactggatatggtaggtgaccagaggacagcactgtttattatcatttctgatacggatgatacttttaactttgttgtggcgatgatgtacagccagttattcaacctgttatgtgacagagcggacgatgtacatcatggaagattgccatatcatgtcagaatcctctgtgacgagttcgcaaatatcggtcagattccaaagtttgacaagctgattgccaccattcgtagcagggaaatctctgcatccattatcctccagtcgcagtcccagttaaagacaatctacaaagatgcagctgaaacaatcttaggcaactgcgacacgatgttattccttggcggtaaggaaagttcgaccttaaaggagatttccgagacgctgggaaaagaaacgattgatttatataacacttcggacacccgtggacagagccgttcttacgggatgaactatcaaaaaacaggaaaggaattgatgagccgggacgaacttgcggtcatggatggcagcaaatgtatcttgcagcttcgaggtgtaagaccatttttcagtgacaagttcgatattaccaaacacaaacggtataaggagctgtcagactacgataagaaaaatgagtttgatgtggaagcgtatatgcggcatcggatggaagtgaaactgacgaggacacaggaatttgacctgtatgagttttcggaagagagtctggcaggagaattaaatacagaaaacaaggaagcagagcatgtgaaagattcggacacatagctcttttttctttgcccttttgggaggtgatggatttgagagatcatgaaaggccacccgtaagggcagagccggaaaagacttcttaaagatagaaaccagagaaatacagagatttgaaaggagacaacgaatatggcgttttttaatcaggcaatcaatattttgcagacacttgtggtggcgattggagccggacttgcagtatggggtgttattaacctgttagaaggatatggaaacgacaacccaggtgcaaagtcccagggaatcaagcagtttatggctaattaaagggaacaaaaagaaaggaaaagcacaatccagacggtatcagcggcaggatacaagaataaattgtgattacacaagattggtgttataataagagaaaagttcctgccggggcagccgccccggtggtatggataaaaaggcaggaaaacaatatgcacatcagctataaaccactctggcatacactgttagagcgtgatatgagaaaagaagatttaaggcttgccgccggtatgacaacgaatatgattgccaacatgagcaaagagggaaagcacatcagcatggatacattggcccgtatctgcgaaacgctgaattgtgagattaccgatgtgattgagttagtaccagacgagcctgcttccacaggaggtaaggaacatgagcgaattgaaaccaagaataacggaaaacggaattgattatatccttgtcggagattactatatcccagatttgaagctgccggaggaacaccgccctatcggaaagtacggacggatgcaccgggaatatttaagagaagcccacccagccagattgaacacattgacactgaccggggagttatggacatatcttgcagacctgaacgaacaggcacaggaacggttagacaccatcatggagcagatgaaggctgccgatggtgtgaccgaggaattgaagcgtacccatcaaatggaatgggtgcagcgttgcaataacattcacaaccgggcagaagaaattattttgcaagagatgatttattcataacggtatggtagaatgattatgacaaatcgaaagttgacaaggagttttgatagcgtgaaaaaaagataaagtccgtataattgtgtaaaagtaaaaaggccatataacagtccttttacggtacaatgtttttaacgacaaaaacatacccaggaggacttttacatgacccaagtacattttacactgaaaagcgaagagattcaaagcattattgaatattctgtaaaggatgacgtttctaaaaatattttaacaacggtatttaatcaactaatggaaaatcaacgaacagaatatattcaagcaaaagaatatgaacgaacagaaaaccgacaaagtcaacgaaatggctattatgagcgcagctttacgacacgtgtaggcacgctagaattaaaagtacccagaacacgtgatggccatttttcacccacagtgtttgaacgttatcaacgaaacgaaaaagccctcatggcttcaatgttggaaatgtatgtatcaggcgtttcaactcgtaaagtatcaaaaattgtggaagaactttgtggtaaatccgtctctaagtccttcgtttctagcttaacagaacagctagaacctatggttaacgagtggcagaatcgtttattatcagaaaaaaattatccttacttaatgaccgatgtactctatataaaagtacgagaagaaaatcgagtactctcaaaaagctgtcatatagcgattggaataaccaaagatggcgaccgtgaaattatcggcttcatgattcaaagtggcgaaagcgaagagacctggacaacattttttgaatacctaaaagaacgcggtttacaaggtacggaactcgttatttctgatgcgcacaaaggattagtctctgccattagaaaatccttcaccaacgtaagttggcaaagatgccaagttcacttcctaagaaatatctttaccaccattcctaaaaaaaattcaaaatctttcagagaagctgttaaaggaatttttaagttcacagatattaacttagcgcgtgaggctaaaaatcgattgattcatgattatatcgatcaaccaaaatattcaaaagcttgcgcatcattggatgatggattcgaagacgcctttcaatataccgtacaaggaaattcccacaatcgactaaagagtaccaatctaattgaacgactgaatcaagaagtacgcagaagagaaaagattattcgcatcttccccaatcaaacatcagccaatcgcttaattggagccgttcttatggacctacatgatgaatggatttattcttcaagaaaatacatcaattttgataagtagaaatggtaaaaacattgtatagcattttacacaggagtctggacttgactgagtttttaattgatgataatatggtttttgatattgataatttaaaaggatttcttaatgataccagttcatttgggtttatagctaaagaaaataataaaattataggatttgcatattgctatacacttttaagacctgatggaaaaacaatgttttatttacactcaataggaatgttacctaactatcaagacaaaggttatggttcaaaattattatcttttattaaggaatattctaaagagattggttgttctgaaatgtttttaataactgataaaggtaatcctagagcttgccatgtatatgaaaaattaggtggtaaaaatgattataaagatgaaatagtatatgtatatgattatgaaaaaggtgataaataaatgaatatagttgaaaatgaaatatgtataagaactttaatagatgatgattttcctttgatgttaaaatggttaactgatgaaagagtattagaattttatggtggtagagataaaaaatatacattagaatcattaaaaaaacattatacagagccttgggaagatgaagtttttagagtaattattgaatataacaatgttcctattggatatggacaaatatataaaatgtatgatgagttatatactgattatcattatccaaaaactgatgagatagtctatggtatggatcaatttataggagagccaaattattggagtaaaggaattggtacaagatatattaaattgatttttgaatttttgaaaaaagaaagaaatgctaatgcagttattttagaccctcataaaaataatccaagagcaataagggcataccaaaaatctggttttagaattattgaagatttgccagaacatgaattacacgagggcaaaaaagaagattgttatttaatggaatatagatatgatgataatgccacaaatgttaaggcaatgaaatatttaattgagcattactttgataatttcaaagtagatagtattgaaataatcggtagtggttatgatagtgtggcatatttagttaataatgaatacatttttaaaacaaaatttagtactaataagaaaaaaggttatgcaaaagaaaaagcaatatataattttttaaatacaaatttagaaactaatgtaaaaattcctaatattgaatattcgtatattagtgatgaattatctatactaggttataaagaaattaaaggaacttttttaacaccagaaatttattctactatgtcagaagaagaacaaaatttgttaaaacgagatattgccagttttttaagacaaatgcacggtttagattatacagatattagtgaatgtactattgataataaacaaaatgtattagaagagtatatattgttgcgtgaaactatttataatgatttaactgatatagaaaaagattatatagaaagttttatggaaagactaaatgcaacaacagtttttgagggtaaaaagtgtttatgccataatgattttagttgtaatcatctattgttagatggcaataatagattaactggaataattgattttggagattctggaattatagatgaatattgtgattttatatacttacttgaagatagtgaagaagaaataggaacaaattttggagaagatatattaagaatgtatggaaatatagatattgagaaagcaaaagaatatcaagatatagttgaagaatattatcctattgaaactattgtttatggaattaaaaatattaaacaggaatttatcgaaaatggtagaaaagaaatttataaaaggacttataaagattgattatataatatatgaaaagctattataaaagacattagtattaaatagtttaaaaaaatgaaaaataataaaggaaaaaaatatttcttaaaattgtgataggggttgttcttgcttgtattttatttgtttgttttctttatacgaacaatgagatcggcgtgacttcatctaagctggaggcagatattcgttcgtcgcagaagattaaggatgattggacggtcgatggaagcgtttccagcacgatggctgcatatatttcttaccctcaggatttgagtgaccattctttttccgtctatgtcaatcgtccaggactttccttcggatattttttccgtggaggtggaactctttcggggattcaaagaggaattgtggagtttactgtagagggatataatgaacgagcatttatttctatgaatcaacagcaggtgcaacaacttgaaatagatgatggcaacacaattcaagtggttgatattgaccgcaataaaccttttgcgattgtcttgcctataaatgcgggtaatattactttttatgatgtaaatagaaatactgtggaatattggaataatcctctttgacaaattccagtttgtcgtgctaaaaattcaactgaataatcccagcaaaaaccgctgctacatggaagccaacaaaccatgcaacagcggtttttctttatcgttttttcctctggctgataggcgttcccattttctttgattttttgagaatccgaatcagccagcgaaattcttcatctgacagatttttatagttgataccaagctgcttacagtaaaggacaaccagcttttcatcacggctgcccttgaaattttcaaccgcttccagattttctttcagttcatcggcaacggtggtctgaggtgcactctcgctgtcctttttatgggcttcccgaatatcccggataatcaggttgaggtcatcccgtaccatgtgactgaaatattcatcatcactgatatgggcggcttgcaacactttcaaatgggggtcatcttcgccggggcgataccgttcaatgatttcatgccggacggtatcgacaagggcgttgaggttttgaatctgcatggtggcaatcccatccacataaatctcaatgtccgcaagaaacttgataaagtccttatgggtggcaagttcgcacagcagacggttgttaatccgaccgcttttcagaagtgctaccatctcatcactcaaatgcagctcccttaatggcgtgttgatctccgcccggttctctgtccggcaaaagagataatcgagggacaccccataaaaatctgccagcaggataaggttgccatgattgatttccttatagtcgtctttttcataactgccaagagccgattttgaaatacccgtttgctcagccagttcttccagttttaatcctttgtttaatcgtaaatcttttagccgttcctgtattgtagtagctccgttcattgaagcagttccccctttctaacgacatttataaccgttgaattgattataccatatcaattccgcaatcgtggaaatttctgatttttaccccgaattcctactttgtggacatacggcacagggcacaaaaatgttctatgatacaggtagttcatcgatggattattccaatcgaatgaccagcctgtgtgggatatgcttccccggcgatgtagcgtcatgacttttggcagggatatggaggaaccctgaccaaaacgagcgtaccaaagggagcgatacgccgctgtgagattcaggggaggaacgacaccggggagaactggcgaactgacaccgaaatgataccgaaacacaacaatctgatagggggacagtctaccctatcgctgatacttcgggagattttaagcggctctatggctgtaattttaccgaaaatcgccccgaaaccatacactaaaacgggaggaagcgcaatatgccgagaatgagcaaaaagaggaagcatgagctttctttttacctcaatgaccgggggcgtgtcacttacaacgaattatgccggaaatgccagcatgggtgcaggcagagcttccgggcggttgtgattgactgcccccgttatttatccaaacgagccaagaaaaaggaggaacacaccgaatgaattttgaatttatgacgatagacacaccattgccgccctgtatgccttttcccagagcgttgacaggatttccagtcagcagcaccgcaaaggtcatgtactgccggatgctggacgctatgctatccaaagggcaggaggacgagaacggaatcctgtttgtctgcttccctgtcacagccattgccgcagtcttgtcccgcagccccatgacggtcaagcgttctttgaatgaactggaaaccgccggacttatcatgcgggtgcgtcagggcgttggagaaccaaaccggatttatgtactgataccgggaaagggggacgctgcccttgcctgatacctcaaagctggaaaagctaaaccgggagctggagaaaagcgaaaagaaactgcggaaagcaatcaatgatgaaaaggcattgcagcaccagttaaagcagcttacccgaaaggaacggacgcaccggctctgtacccgtggcggtatgctggaaagttttctgcaagagccggaacgcctgacagatgatgatgtcatggtgttgctcaaaatcatttttcacaggcaggacacgcaggaactattgaaaaaactgctggaacggaagaagccggaaaccccttagtttactaagggcgcaattatacaccacccagaggttggtgcattgcgttctccgaaggctcctcgccggagggctgtgattttccgcagtcatggtctgctccaaatcatacaggggacgctacgcttcccctgcgctggctgccgccagctacccttttgtggacttgccatctggggacaccttgcgttgcaagctgttcccagccgacaagtttcataaaatatgctatcttttcgatagccaatgaagtataatgaagatgacaacaaatcggtagttgacaaggagttttgatagcgtgaaaaaaatatttcttaaaattgtgataggggttgttcttgcttgtattttatttgtttgttttctttatacgaacaatgagatcggcgtgacttcatctaagctggaggcagatattcgttcgtcgcagaagattaaggatgattggacggtcgatggaagcgtttccagcacgatggctgcatatatttcttaccctcaggatttgagtgaccattctttttccgtctatgtcaaccgtcctggtctttcctttggatactttttccgtgggggtggaaacctttcgggggttcaaagaggaattgccgagtacaccgtagaaggatataatgagcgagcatttatttctatgaatcagcaacaggtaacacagcttgaaatagatgacggcaacacaattcaagtgcttgacattgacagcaataaaccttttgcgattgttttgcctataagtgcgggaaccattacattctatgatgtgaatggcaatactgtggaatactggaacaattctctttgacaacttccagtttgtcagcttcacatcgggtcaacttgccccgaacttttacaattaaatacccgccgcccacatagcggcacaccgagcaggaaatctgaaaaaggtctcctgctttttttctgcccaaaatgagatggtaaaacgccaccccgtccaccaattagcgaaaggagggacacgaaatgccctgtccacacaacgaaatcacgattgttcagcgcagccagcggcagtctgcggttgccgccgctgcttaccagagtggcgaaaagctgttctgtgaatacgaccagcaagtgaagcactacccggaaaagcgtggtatcgtccacaatgagattctgctcccagcaaatgccccgccggagtatgcagaccgtaataccttatggaacgccgccgaagcggtggagaagcaatggaactcccagcttgcaaggcggtgggtgcttaccatccccagagagataccgcctgaccagtacgctgtccttgtccgagagttttgccagcagcagtttgtttccaaagggatgattgttgactttgccatccatgacccccacccgccgggacacaatccccacgcccatgtcctgctgaccatgcgggcaatggacgaacatgggaaatggcttcccaagagccgcaaggtttatgacattgatgaaaacggggaacggataaagctgccgtccggcaggtggaaaagccataaggagaatacggttgactggaacgaccagaagtattgtgaaatctggcggcatgaatgggaggttatccagaaccgctatctggaagccaataaccgcccggagcgtgtggacttgcgttcctatgccagacaggggcttgatatagtccccactgtccatgagggggctgctgtccggcagatggaaaagcgtggaatccagacgaatatcggcaacctgaaccgggaaatcaaagccgccaacagtttaatgcagtccatccggcagctcatccacaacctcaaaggctggattaccgagctgggagaaaaacggaaggaactgcttgcacaaaaggaggcggaggaagcgacacttcttcccaatctgctgatgaaatatatggagatacgaaaggaagaacggaaggactggacgagggctgggcagaaccgggggacttccaaagacttaaaggcagtcagcgaagccctgtcctatctccggcaaaaggggctttccactgtggaggacttagaagcgtttctggaatcttccgggaaatcagccgcagattaccgcaatcagatgaagccaaaggaagcccggagcaaagtgattgacgggattcttgccagccggacagactgcaaggaatgtaaggctgtctatgagaagtaccagaagatattttttaagaaaacaaaggagaaattcaaacaggaacacccggaggttgcccggtatgagaaagccgttgactaccttgccaagcacccggacgataaggataaaacgaaaaatgagttgcaacaggagcaggaaacgcttctcagcgaaatcgcagagctgaaagtaccactgaccgaggtacaggaggatttgaagaagctgcgggacatccgctactgggtacggaaagccacacccggcacagaggaaagcaaagagccgcccaagaagcagcccatcaaagaagtcttgcaggataaggcagacgagaaaaaagcacaaagaacagcccaggcacagacgaaacacagacaacaggatatggaactttaacaggcacttgccattttcaatcagagaatgtcaggtgcttttctttttttcaaggagggatagatttgaatgtatttgaagttgtgaagcagtccgttacaacaagacaggctgcggagcattatggaatccatgtaggtcggaacgggatggcttgctgcccgttccataacgataaaaccccaagcatgaagctggataggcgttaccactgcttcggctgcggtgcggatggggatgtgattgattttgccgccgccctgtatgggctgggaaagaaagaagccgccatacaactggcacaggacttcgggctttcctatgaggattggaagccgccgggaaaggcgaaaaagcccaagccccggcagaaatcccaggaggaacagtttcaggaagcaaagaaccgctgcttccgtattcttgccgattatctccacttgcttatggcatggagaacggactacgccccacactccccggaggaagcctttcatccccggtttgtggaagccttacagaagcaagcccaagtggaatatcagctggatgtgctgctgttcggggaaacagaggaaaaagcggctttgattacggactacggaaaggatgtgatacagcttgaacagcgaatggcagagcttgccgccacagacgcagcaggaactaaaaaacaccatgaacgccatgcagccgccccagagcgcccctgaaatcaaggcggggctggaaaccaccgagaaaggcggtgtccgtcagagcatacggaactgcctgaccgtattccagcgtgatccgctgctttccggagctatcgcatacaacatcctgaccgaccgcaaggacatcataaagcccatcggcttccacagggaaagcaccgccttaaacgatacggacatgaagtatctgcttctctatctggaagaaacctacgggcttaccaatgagaaaaagattgataacgccatcggaattgtggcgaatgaaaacaagtatcatcccatccgggattatttaagttcccttgtgtgggacggaaaggaacgaatccgcttctgcctgcggcactttctgggggctgacgcagatgattacacctatgaagcgttgaagctgtttctgatgggcgctatctcacgagcctttcagccggggtgcaagtttgaaatcatgctctgtctggtaggcggtcagggggctggcaagtccactttcttccgtctgctggcagtccgggatgagtggttctccgatgatttgcggaagctggacgatgacaatgtgtaccgcaagctgcaaggtcattggattattgaaatgtcggaaatgatggcaaccgccaacgccaagagcattgaggaaatcaagtcgtttttaagccggcagaaagaggtttacaagataccttatgaaacccacccggcagaccgcccccggcagtgcgtgtttggcggcacttccaatgcccttgacttcctgccccttgaccgttccggcaaccgccgctttatccccgtcatggtgtacccggagcaagccgaggttcacattttggaggacgaagctgcttccagagcctatatcgagcagatgtgggcagaagcgatggagatttaccgaagcggcaggttcaagctggctttcagccctgccatgcagcggtatctcaaagaacaccagcgggattttatgccggaggacaccaaagccgggatgatacaggcgtatcttgataagtacaccgggaacatggtctgctccaagcagctctacaaggaagccttaaaccatgcttttgacgagccgaagcaatgggaaatccgggaaatcaacgagattatgaaccagtgcattgaccgctggcggtatttcccgaacccaagaatgttttccgaatatggcagacaaaagggctgggagcgtgaaaacccggcaacggactccggcaacccgtctgaaaaaacgatggacggttttgtggaggtcacagaacagatggagcttccattctgaaaatgacagcccgttgcaccccctgttgctatcccgttgtcgagccggttgccggggaaaatcccataactgcgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgtatggaggataactgcctatggcaaaaaacaaaacagagattcatgttacaacggtgtttgacggggaactggacgccactgatgtgttcgtcagcctgatttcccagaaatacggcaagacaaatacaaaagaatatcttgctaaaaagaaagatttgaagtataatgaagatgaggttcaaaagagccagataccgtctggattgtgtgggtaaatggctatgatgaacgaaatggaatacagaacaatcggttcggcacttgccgggggctatcgtgcagcggtctattgcaggctgtcaaaggacgatgacctgcaaggcgaaagtgccagtatcgcaaaccagcgtgatatgctggaaaaatactgcgaaaagcagggatgggaggttgtggcagtctatcaggatgatggcttcacaggtcttaatatggagcgtcctgatttacagaggatgttgagagccattgagcgcaggcaaatcaaccttgtcatcacgaaagacctcagccgactggggcgtaactatctgcaaaccgggcatttgattgaggactttttcccaagaaacggtgtccgctatattgccatgaatgacggtatcgacaccctgcgggataacaacgacatcgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttctccgttatcaaagaccttttgatgaatcccgtctacaccggggcgattgcttcccagaaaaaagactaccgtttcaaaatcggcacgattggggaaaagaagccggaggactggattgtggtggaggggcagcatgaaccgctgattgaccgcatgagctttgacattgtgcagaataagctgaaatcccgccagcgtccggggcagaccaatgaaatcagcctgtttgccggactgataaaatgcggcgagtgtgggaagtcgctgacggtacgctacacaaacgcaaaacatccccagcagatttattcctgcaagacctacaatgcctttggaaagaaccactgcacccagcaccggattgactatgacaccctttacagccatgtgctgcggaaaatccgggaatgtgccagagctgccctgatggacggggaagcggttgccggccgcctgaccaatacctgtgaagccgagcagcgggaacagcgggaagcaatggaacgctcccttacaagggacgaggaacggattgaggttctggacaaaatggtcatgcggctttatgaggatatgattgcagggcgtatcagtgagcagaatttcaacaccatgctggaaaagacacagaccgagcagacggagcttaaaacaaaagtgtccgagggcagaaagcggctgtccgatgaagtccagcttgccaatgacgcaaaacaatgggtggaagccattcaggaatatgccaacatcacagagctggacgcagccaccctcaaccgcttaatcaaagaaatcgtcgtgcatgaacgcattgacgaagataaaacaagacacatttctatcgaaattcattttaatctcaaacctatcccggaggtggaacaggtcactgcctgacctgtcccgccgggacggttctcttaaaaacaccatatagattttttgtacgccgccgcccgccatcgagcagagttttacacctaattggggataaaacagctgatggcaggaggcggtgtcgttctgatcggcacccagctggtaccgttactgtccggattgttcagctgagagaagcaggagggagatgactcatggatcggatatttgaagcgattgaagaatggatgaggaatcttctgacaggcatggtaagttccaacctgacaacaatgtataccgatgtcaatgaaaagaccggtcagattgctgctcaggttgggcagacaccgcagggctggaatggcagcatttacagcatgatacagaatctttccgagtcggtcattgtaccgattgccggtatgattatcacatttgtactttgttatgagctgatctccatgttgacggaaaagaacaacatgcacgacatcgacacctggatgttctttaaatactttttcaagatgtgggtggcagtctggatcgtcagccatacctttacgatcacgatggcggtatttgatgtcgggcagtccgtagtcagccgggcagctggggttatcagttctgatacagcgatcaatatagatacgatgatctccacgatggagacggcgatggaatctatggagatcggtgaacttgtcatactggcactggaaacgatgcttgtaagcctgtgtatgaagattatctcagtctttattacagtgattttgtatggacgtatgattgagatttatctctattcgtccgttggagcgatcccgttcgcaaccatgtccaaccgggaatgggggcagatcgggaacaactatcttcgtggattgtttgcactggcattccagggattttttatgatggtctgcgtgggaatctatgcggtcctggtcgcaaacatccagatgtcagataacatacattctgcattgttcggcgtgatggcatacacggtgatcctgtgtttcagtctgatgaaaacaggaaacttcgcccgcagtatctttaacgcccattaagaaaggaggaactggcaatggcatttgtatctgtgcctaaagacttaaccaaggtcaagaataagatcattttcaatctgacgaaacggcagctgatctgctttgggattgcggcggcggtagggcttccgttttatttcttaagcaggggaattattggttccagtaacgcagcgaccgggatgtgccttctgatgcttccggcatttttgtttgccatgtatgagaaggatggactcccgttagaaaaggtcttaaaaaatatgatcaccgtaaaatttatccgtcctccggtacgcaagtaccagatggaaaatatgtacgagaaaaagtataccgtggtcaaaaagaagaaagggggaacgaagggtgttaaaaagaaaaaacgatagacagccgccacagagcttagacgaattatatccggatgattactggctggatgaggaggatggagaagaagaacttccagaccccgcaatgaaaagaaaaccagtaagcggcagactgcatgatgagcctatggtgacagggtatgaagcactggaacggcaaagaggtgtccgcagaccgaatcggaaactgacacgcagggaaaagaaagccctcaaaagggcacagaaatatgaagaaaaactgcataaggaacatgaaaaagcggataagaaaaatgcaaaaagggaagcaaagctggcagccagagcagaaaagcaggcagtgcgtgacgcaaagaaaaacgcaaaaaagaaaaagagcagatctgtcgcagcaccgtcggggcagcgtccggcaggaaaagtggtttccggaacgaaaggcagtgggacaggaaagaaaacaccggatagtgccagagataagaggatcactgcacagcagtcgattccataccatgagatgggaagggacggtatctgccgggtgcaggacaagttttattccaagacgatccgtttttatgacatcaactatcagctggcacagaatgaagataagaacgccatctttgaaaactggtgtgatttcctgaattactttgacagcacaattcattttcagctgtcttttatcaaccagcacagcaacatggcagagtatgagaaggtcatccatatcaatccgcaggaggatgaatttgatgacctacgtatggagtttgcccagatgctcaataaccagctggcaaaaggaaataacgggctgatgcgtaccaaatatatcacatttgggattgaagcggagaatatccgggaagcacggccaaaactggaacgtatcgagtcggatattctgaataactttaagatccttggggtatctgcctatccgctgaacggagaggaacggttacagatcatgtatgaaacctttaaccaggacagcaaagttccgttccatttctcttatgacgatgtacttcggacagggcttagtaccaaggattatgtcgcaccgaccagttttgtatttaagaatggaaaagattttgagatgggcggcacgatgggaactgtttcctatttacagatccttgcaccggaacttaccgacaagatgctggcagagtttttggagatggacagcaacctgatggtgaatttccatatccagtccatcgaccagatgaaggcaatcaagctggtaaaaagcaaggtgacggatattaaccgtatgaagatcgaggaacagaaaaaagcagtccgggcaggctatgacatggacattatcccttcggacttaaatacatacggtggggaagcaaaaaggcttctggaagatctacagtccagaaatgagcgaatgttccttgtaacagcattgttcttaaatactgcaccgaccaaacaggaactggaaaatgtggtgttccagactgccggtatcgcacagaaatataactgtgcattgaaacggctggattaccagcaggagccgggactgatgagctgcctgccgcttgcggtgaattttgtaccgatcaaacgggcactgacaacgacatccacggcaatttttgtcccgtttaccacacaggaattatttatggctggggaatctatttattatggattaaatgccctgtccaataaccttatcatggcagacaggaagaaactgaagaacccgaacggactgattcttggtacaccgggttccggtaagtcgtttgcggcaaaacgagagattgcaaatgcatttatcgtgacgaaagatgacattatcgtctgtgacccggagggggagtattatccgttagtccgggcatttcatggacaggtgatccgtatttccccgaccagccacgattatatcaatccgatggatattaacctggattacgctgacgatgatgacccgctttccttaaaatcggacttcatcctgtctctttgtgagctggtagtaggcggaaagaacggactggagccggttgaaaagaccgtcattgaccgatgcgtaaggctggtctatcaggatttcctttctgacccggtaccggaaaaaatgccgattttagaggatttatataatcttctccgtaatcagaaagagcaggaagcacagcgtctggcaacggcactggagatttacgtcaatggttccttaaaagtgtttaaccatagaaccaacgtggaactgagtaaccgtatcgtatgttttgacattaaggatctgggaaaacagctgaaaaaactgggtatgctgatcgtgcaggaccaggtgtggaacagggtaacggtcaaccgttctgcgaataagagtaccagatattacattgatgagttccatctgctcttaaaagaggagcagacggcagcatacagtgtggagatctggaagcgtttccgtaaatggggtggtatccctacgggtatcacacagaacgtaaaagacctgttagccagccgggagattgagaacatctttgaaaactcggactttatcctgatgctcaaccaggcatctggtgacagacagatccttgcaaaacagctcaacatttcccctcaccagctttcttatgtaacgaacagcggggaaggtgagggactggtcttttatggcagcaccattatcccgttcaaggataagtttgataattccctgatgctgtatgccctgatgacttctaagccggatgaggtggaaaagcgtaagaaacttggtatcggagaacgggacgattaaagaaataaacgaaacaaaataaaacagagtagaggatgagccggaggaatacttccggcaatttttctgcctggaaatcatggaggattacaagatggaagattacagaaacatggagagatgcagcggcgaaccttgctgcatatttgcagaaagaatctgtgcagacaatgaaaaggagattttgagaatggaaaaggacacaaaggaaaaagtgacggctgatgaaatgatggatgaccttatctatctggcggaactgattgatttcatgggaattacatcttgtctggctgtaaggggaactttaagtgagcgaatgacagacaagctgacggattccattgcagggatggcagatgaagtgttggagaaatgggagaactatcaggataagacagaataaccgggacaaagcagtaaaggggatggtcaaagttgcaggagcatgagtataaggcgagagataaaaccgtccagaagatgagccgggatggactgcgggaagaaaacctccggaacaaggaagaaaaaaggatcaccgggcgggatacggataccgagatttcccgcagtgagaagaaagaggaactggattttagtaaacgcagacatgaacggctgaaagaagaacgggagatggaacagccggagcagagttccagaaaaccaagatatagtagagattatgtatccgaccaggatataaaaccagatatggatgaagatgtagatacagatgtagatgtttctgttgaaaatggagaaaatcccaaatctgcatttcgcacagagagtatccgtggacagccaagaggagaacgggcgtatctggagacagttgcggacagccgggaccttcggaagaaaaagatggtcagggattatgctgcaaaggaaagaaggaaggaaaaggaggcttccagagaggaaaaagcagccaaaagagaatctgcccgttaccgggcaacttccgaagtgatggaagattccctggacgagttccaggaggagattaaaggcaagtccaaaagggaacgggtgctgaaagagcagcggaaaaaagtttcccgcctgtctttcggggatgaaggtgacggtatggtacatggtgctggcattggtatccggaatccggcatccgcagtcaaagatgcggcagtcactgcagcccattggaaaactcacgaagaagaggacgagaatgcggcagtagaaggggcacatcgggcagagcttgccggggaaagccttgcaaggaaatccatttacatgaggcaacgcttaaaaggaaggagggaagaatcccggagattaaaagaaagtgtactggatgaagcagaaaagagcaggctgatgtttgaaactgtctatgaaaataaagcaaaaaatgcagtgaaaaaagaagccgagcagaaaaagaaatctgctctgcagaaactctttcagaagaagcgttaccagaagcagtatcaggcagccagacagagtaaaaaagtaaaggatgcggcgatcacttccgcacagaagtttacggaaaaagcgaaagatgcagtcaagatggtggcagcacagaaccgtgggatttttgctacggtagccatttttgccctgatctttttgctgatcgcagccagttttaccagctgtacggcatcactgcagggagcgtcctctgctatcatctcgaccagttattccagtacggatgaggatatttatgctgctgaaaatgcgtaccgggctttggaagaagcactgaacacacaggtcaaccagatggaatccacccatccggattatgatgaataccggtatcagattgatgagattggtcataacccatatcagttgatctcttatcttacggtaaaatacggcggcttcacttacgatgaagtggcagatgagattaaggagatcttccgacagcagtatggaatcaccacagactctaccagagaaacagttacagaaaccaagactgtccgggtaggggagtccttgggactggttgtgacaagtgggtactgtaactgcccaatctgctgtggccagtggagtggcggaccgacagccagtggggcaatgccgacagcaaaccatacgattgccgtggatgcggcgaatccatttgtgccgatcgggacccatgtcgtcatgaacggtgtggaatatgtagtagaagataccggagcgttcgcaagatatggggtacagttcgatgtttactatgacaatcatgcggcggcatccgcacatggacaccagacatgggaagcctacatagcagacagcaatggaaaccaggaagtgcaggtcacgactacaaaagaggtgaaccgtctggatgtgacgatgacaaaccacagcctggatgccgtgttaaggagccgtatgacagaggaagaacaggaacgctacgatgcgtataacaaatattacggcaaccgtgattatctgtttgatctaaacagcatacccaccggaagcagtggatttggttatgacataccggcagatgctttatctgatccacagtttgcaaaaatgatacaggaagcagaaaaatatctgggtgttccatatgtatggggcggttattccccaagtggttttgactgttccggttttgtgagctgggttatcaataactgtggaaatggatggaatgtcggaagatgtactgcagatgagctgcggtcacactgttcgcaggtatctccatcggaggcaaaaccgggagatctgatcttcttccagggaacctatgacacaccgggagcaagccatgtgggaatctatgtcggcaataacatgatgatccactgtggcaagcctgtccagtataccagcattgcaagtgcttactggcaggaacattttatggcgtttggtcgtctgcattaaaggaggtgacagggcagatgaacatgaaattaaaaaaacttctgaatgatattcagaaaacggaggataagattgctgaattacaggaacacctgaagcggcagaatacattgagacagcagatggaagatatagagatcgttaagtcgttccgttccatgaagctggacagccgcagcctgcttgtcctgcttgacgggattcagaaaggaaccgttacgatccagatggatgaggacggtggtatcacggtggaggatgcaaaagctccgcagaaaaaggaaaacaacacagaagttcacagaccacctgttggtcagatgacagaaagagaggttttagacgatgaggaataaagtggtaaagaaactgcttatgattgccatggcagtcaccatgatctccgggacatccattgctacggtttatgcaaatgcaaacccaccggcagaggagacaacgacacaggtagtagaagaaacggcaacagaatcaacagaagatacggagaagaaagaggataccggaagggtcaccggggaaggagataattctgctttttctactccgggaaatgcccagctggtggatgataaggaaaatgatgatacgaaacagttccttaccatccagaccaagaagggaaatacattttacatggtcattgaccgttccagcaatacagaaaatgtatatatgatgtccctggtcgatgagaatgacctggcagaatttctggatgagacagaaaagagcaaagaaaccgaagaatcaaccgtagtgatcccggaaaccacaccggaaactaccccggtagcagaggaggaaaccgaagtgaagaaagaagaaaagacaggaatgaatgtaaaaggacttggagcaatcgtacttgcagcgattcttggagtggcaggtatcgccgtttataaaaagcatggacgtggcaaagaggatgactatgtaagcgaacagctggagttctctgacggaccgtatgtaaatgaagaagaggatgaggaagaagaataaacttccatctccaaagaagcaaccaaaataaggacaggggcagccagagcagtttggctgcccttttttcagaaaggacaaaaaaagcgtatgtcaaaatttttagtgatcgcagagaaaccaagtgtggcacagagttatgccaaaaatctgtcagcttataaaaaagaggacggatatttagaaggggagagctgtattgtcagctggtgccttgggcatctggcagagtatgcacagccggaggaatatgacccgaaatatgagaaatggcagtttgatgaccttccgattctcccgcaggtctggaagttgaaagtttccagagataaaaagaaacagtttgatgtgttaaaaagcctgatgaaccgggcagatgtggactatctggtaaatggctgtgatgcaggaagggaaggggaactgatcttccagagagtgtatgaccttgccggatgcaggaaaccggtgaagcgtttatggatcagttccatggaagatacggcaatccggataggttttcagacaatgaaaggagcagaggaataccggaatatctgcatggctgcggtatgcagggcacaggcagactggctgatcggaatgaacggaactagggcatatacgacctgttattttaaacgtctggttgtgggcagggtgcagacgccaacgcttgccatgcttgcggaacgtcaggataagattgagcattttcagaaagaagccttttataaagtagcactgacagacggaaggcttacggtagtttctgaaaatattgcaaatgaggaagcagccgatctccttgcttccttatgtatggattcggaagcagtgattacacagataaagagggaacaaaagaaagcgtttcctcccaaactttatgatctgaccagtctgcaaagggaagcaaaccgttactttggctatacggcaaagaaaacactggatatgctgcaggaattatatgaagaaaagctggtcacttatccaagaacggacagccagttcgtgacggaggatatgggggataccgtagaggaactggtagggaaaatgccagtcttacttccgttcttggattatggacagctgggacataacatcaccagagtgattaacaatgcaaaagtatccgaccatcatgcgattcttccaacaaaagaagccgtagaaaaaggaatctctgatctgacagcggacaaaaagaacctgatgatgctggtctgccagcagctggtgcaggcaacaggggaagagtatcagtatgagcagacggatattatggtcaaatgtcagggacatgattttaccgccagaggaaaagtgccggtgcagatgggatttaaagcggcggggaatgcctttaagaaccagtgcgtgaaagccaagccggaagaagaaacggaaaaagaaacttccatcccatatggatatgaagaaggaatgacgctttctccggtaaaggcagaaaagacagtgcattttacttccccgccaaaaccattcaatgaagataccctccttgccgctatggaaaccgcagggaataaagactttgattcggagacagagaagaaaggactggggactccggcaaccagggcaggtatcattgaaaaactggtttcttccggctatgcagtcagaaaaggaaagcagatcttgccaagcacagagggcagggaactggtgaatgtcatgccggcttatctgaaatctgccgcaatgactgccgaatgggaaaatcagcttttaatgatggaaaaagggcagatcaccgatacacagtttatgggtgagatcacttctttagtcggtaagattctttctgtgtgcagggaaataccggaaacggaaaggagaaggttccagaaagcaagggaagtgatcggtaagtgtccggtctgcggctctgatgtctacgaaggaaagcagaatttttactgctccaacaggcagtgtgattttgccctttggaaagaaaaccgtttcttaggaagcatggagaaaacactggataaaaagatggcagtggagcttcttgataaagcctgcacccatgtaaaagggctgtattccagaaaaaaagatataaagtttgacgcagatcttttactgacactggaggacggaaagccaaggttccatctggaatttccaaagaagaaaaagaaataagacaaggaggtaggcagtatgtcgaaattacaggacatccgggaactggcacaggaacatgcgacattggtgagcagttcgccaagggactggatgggttatatggataccgcagcgagactataccggtatccttttacagaccagttactgatccacgcacagcatccacaggcaaccgcctgtgcgtccctggaactgtggaatgagaagatgttccgctgggtaaaccggggagctaggggaatcgccctgcttgacgagaatggtcataataccagactccggtatgtgtttgatatttcagatacgcacatggtggcaggcggaagaagcccttacctgtggcagatgcaggaacatcagcaggaagagatccttaaccatttagcagaagcgtatggtctggaagaaaaagatacagggactttatcggatgcgttgatggcggttgcaagggaaatggtcgcagacagtctggaagaatatctggacggcttggaatatgcagcggaaggaacgtatctggaagatctggatgaagttacgatccgcagtgatttccgccagcttgcaacggacagtgtatattacatgctttccagacgatgcgggcttgaaccgatggaacttctggaagaagaggacttcatgcatatcacagattataaccggctgtctgtactgacctttcttggaaatgcagcaagccagatcagtgagagtgttctgattgacattggaaggacggtacataaaatttctctggaagaagccagaaaagaggttgaaatttccaatgaaaggaattataataactttaacacgttaatgcgtgaaaataaaaataagggcgtagaaaacaacaaagaagaaaatatcgagaatgaaggaggaaccgactatggaactgacatatcatcgcaagggggattacctgtttccgaacctgaccgtagaggaggaagaagtgacaatagggaaatacgggatgcttcggaggacattcctgaaggaacacaagaacagcctgtatcagagcctgttcctgacaggaaagctgaacagccatctggcagagatcgagaaggcagcacaggagaggatggacagccagatggagaaactgctgaagaaccatccggcaccggacaaggaagcagacccgatggcctggacagcacatatgaacgcactgatggcaacagcggaagagagcatcttgacggaattggtatacagctagttgaagatacaagagaagatggactgagcaaagcagaggaagaaattgcctctgctttatctttgcccgaatatcctacagcaaatgaacagaaaaggcagattggtgaaagagtagctgctttatatgccggggagattcctattccggaaagtgttgtggatgatattttacggacgggaggaaaccggacaggaagccagctgcgtatcatctataactttatgagtgaacagtcaccgggagaatacacggagtttgtaaagcgtgagtatggaaaaggcggcaaaggttttcagatggatggaagggagtattccgtctggtttgatgaaactgggatgcagatcgcagtcgggcatacggtggcagaccagattctggataaagcctttttatcctggaaagatgtcagcagacgtatccatcagcttttagaccagggtgaatatgcaccgcagtctgtattggatgcagcaagaaacaatgcagtaaaagaacatgcacaggctcttgcctatatgaaaggggatatggcagaaggggtagccgagattgtttttgatgaggaggatttaccacatcttcacagtatctatccggagatcacggattatctggaagaaaagctggaagatccacagtggctttcggaactgaatgaaagactggatgcactggcagaagcctatgaagaaaatcattccattatgcgtttccatcattatgatcctataaatatctcaaagcagtttcagaagtttgcggatgaggtcatcccttatcaggcaagagacgggtttgcatggaaagaccatccgatgttcattacgcaggatgagattgatgcttatcttgcaggaggtggagcgtattcgcagggcaggcttaggacgtattccttttatctgctgcatgaagatgaaagatcgaggacaggttttatcaaggaacagtatgggatcggtggaagcagtcatgcactgtctggtgcggatgattcacacgcaaattatgatggaaaaggattgtttcttgcaagaggtgcttatggaaatccatatacgtcagttttattatcttggaataaagttgcaaatagagtagcttatctgataaagaatgaccagttcctgcaggcagaagattatgctcgtatgccggaatatgaacaggaacagatggcgaacaaggtactccgcttttatgaccgtcttccggaagagatagacagaccatttacggatgatttcttctgggaaaaaccaggaaaagaaatggtggcagtattagagaatccagagcagacagaagaactgttacagaagatggatgcagcattggcagctcttccattggattttgaagcgtatgggacaaactatcagcagaaaacagaacttctttcagaactccaccagtatgcagaaggaacctatacgatattcccgacaccggaagcagaaccgtcttttgcggaaccatccgggcaccagatgaccatgtttgatttcttggatacgaaggcagtgacagaaccgaccgtagtagatatgtcagatgtggaggaaatagaagaggaagaggttactgccaaagaagatattccggaaaatcaggaacaggaaataacagaaacttctgagggacaggaacaaaaggaatcagaagaagagataacggttaaaacagcagaagaactggcggagtcctgggatgaaggtgtttttgagtatcaggggtatcattttgaagcagtaggggtattgccggaaggaatagaaggaaaagatctggttgcacagacccgttccaatacagaactgcatttatcgacctaccatacagaagatttcccaaagtattcttatgatgatttttatgcagtcagcaatgcaccaactgccgatgtgttccggtgtctggaaaccggacgcaattatattccgggagaaaatgaactgtttggatatgagggagaatttcaaccatatttaaaaccggaagtagaagagattgtaacagaaccgcataactttcggattcaggataatgaccttggagcaggtggtccgaaagcaaagtataaagcaaatatggaagccatccatttattgcagactctggagcaggaagaacgtctggcaacacccgaagaacaggaaattttatcccgttatgttggctggggtggcatcccgcaggcatttgaagagaaaaacagtagttggacaaatgagtatctggagttaaagaataccttatcaccggaagaatacagtgcagcaagagcatcgaccttaaatgctttttatacatcaccgactgtgatccgaagcatgtatgaagcactggaaaatatgggactgaaacagggaaatattctggaaccgtcctgtggtgttggtaactttatgggactgatcccggagagtatgaacaaggcaaagatgtacggtgtggaactcgacccggtttcgggcaagatcgcaaaacagctttaccagaaaaataagattgccgtgcagggatttgaggaaaccagttatccagacagctttttcgactgtgtgataggcaatgttccgtttggatcgtatcaggtcagtgaccgcagatatgaccggcatcattttatgatccacgattattttattgcaaaatcccttgatctgatccgtcccggcggtgtagtggctgtggtaacttccagtggaacgatggataagcagaatccggcagtgagacagtatatcgcaaaccgggcagaactgcttggagccatccgattaccgaataatgcgttccagagaaatgccaataccagcgttgtttctgatattctgtttttccagaaaagggacagggcatccattgaggaaccggaatggttaaatttaaaggaaacaccggaaggctattcagtcaatgcttattttgcagagcatccggaaatggtgcttggtgagtttactacagaaagtacccagtatggaaagcaggaagtgaccgtaaaaccaaaagaaggaattaccttagaagaacaattaaaagaagccgtccagaatatccatggtacgatcacggaactggaactttcggatacagagttggaggaggatgttgtctctatcccggcagacccagatgtaaagaatttcagttataccgtagtgaatgatgaagtctattaccgggaaaattctgtgatgaatcggatggaacttccggcaatgacagcggaacgtgtcaaagggatggtgaagatccgtgatgttacgaatgaactgatccagtgccagatggaagagggaagcgatgaacagatcacaaagctgcagggaaaactcaatgaagaatacgatacctttacagcaaaatatggtcttctcagcagcaatgccaataagcgggcatttagtcaggacagcagctattgtcttttgacttctctggaatttctggatgataagggagaactgaaacgaaaagcggatatttttaccaaaaggacaatccgcagggcagaaacggtaacttctgtagatactgccagtgaggcacttgcggtttctatcggtgagagggcaggcgttgacctttcttatatggcacagctttccgggaaaacagaagaggagcttaccgaagaactggcagggataatctttaagaacccgatcagtgaaaaatgggagccatcggacgaatatctttctggaaatgtgagggagaaactgcagatcgccaaacagtttgcagaggatcacccggaatatcaggtgaacgtgcagtatttggagcaggtacagccaaaagatctggatgcatcagagattgaggcaagacttggggcaacctggatctccgaggattacattacacggtttatggcagagacattccatacaccaagatattatgtagggagcaaggtcaaagtccagtatgcagaagtgaccggacagtggaatgttatgggaaagaatgtggacagctacggaaatgctcttgtcacttccacatacggaacacagagagccaatgcctaccgccttttggaagatgccttaaacctccgggataccaagatttatgacacggtacaggatgccgatggagaacaccgggaattaaaccggaaggaaacgatgctggcacagcagaagcaggaactgatcaaagaggaatttaaggagtggatatttaaagacctgcaccgacgggaagatctctgtaagatctataatgaacgatttaacagcatccgtccacgggaatatgatggaagccatattcagtttgttggcatgaatccggagatcaccctgatgccgcatcagaaaaacgcagtggctcatgtgctgtatggaaataatacgttactggctcattgcgtaggagctggaaagacattccagatgatcgcagccggtatggaatcaaaacggctgggactctcacagaagaatctttatgttgtgccaaaccatctgaccgagcagtggggcagtgatttcttacgactttatcctggggcaaatatcctggtggcaacgaagaaagactttgagccggcgaaccgaaaacgtttctgttcccgtattgcgacaggggattacgatgctgtgatcatcgggcatacacagtttgagaaaatccctctttcaagggaacgtcagattgccatgctggaacagcagattgcagatattacgttctccattgaagaagcagcacatcaggcagggcagaattatactatcaagcagttggaaaaaacaaagaagagtctgcaggcgaggatgaagaaacttaatgaccagaccagaaaggatgatgtagtaacttttgagcagttaggcgtagaccggctgtttgtggatgagagccatagttttaagaacctttttttgtatacaaaaatgcggaatgtggcgggaatctcacagacggatgcacagaaaagttcggatatgtttatgaaatgccggtacatggatgaactgaccggcggcagagggatcacctttgctacaggtactcccgtatcgaacagtatgacggagctttacactatcatgcgttatctccagtatgacacactcatgcgtatgggtatgggacattttgattcctgggcggcaacctttggagagacagtaaccgcaatcgaattatcaccggaaggaacgggctatcgtgcaaaaacacggtttgcccgtttttttaatcttccggagctgatctccatttttaaggaagctgcagatattcagacttctgatatgctgaaccttccagtgccggaagcagagtttatcaatgaagtcttgaaaccaagtgaagaacagcaggaaatggtcagtgcattttcagaacgtgccgaaagtgtaagggcaggcttagtaaatccgaccgaggacaacatgctgaaaatcacgaatgatggaagaaaatgtgcccttgaccagagactgttgaatgaacttctcccggatgccgaaaaaagcaaggtcaatacctgtgtggaaaatgcttttcaggtatgggatgagggaaagacagaccggacaacccagctgatcttctgtgacctgtccacaccaaaaggggatggcagtttcaatgtttacgatgatgtgagggagaagctggttgccagaggaatcccgaaagaagagattgcttttatccatgaatataacacggaggcgaagaaagcggaactgtttgcaaaggtgcgggccggacaggtgagaatcctcatgggttctacaccgaaactcggtgctggtaccaacgtgcaagacaggcttattgctctgcatcaccttgactgtccgtggaagccgtctgatctggaacagcaggaaggacgtattttaagacagggaaaccagaatgacaaagtaaagatattccggtatgtgacggagaacacttttgatgcgtatatgtggcagattttggagaataagcagaagttcatcagtcagatcatgaccagtaaatccccggtcagggcctgtgaagatgtggatgatacggcactgtcctatgcagagatcaaggcacttgctacaggcaatccgtacattaaggaaaaaatggatctggatgtgcaagtgagtaaactgaaactcttaaaggcaaaccataccagtcagatttaccgtctggaatccgatattgcaaagaatttcccggtacagatcagtgcattgaaagagcggattgccgggatgcagatagattcccaggtagtaaaaagcgtggatttacaggataatgacacgtttgccatgacagtaggaaatgtcctttatgaagataagaaagaagcaggcgaggcattgatcgctgcctgtgcaggactaaaaaccgttagcaccggtggaaaggtcggggaatatcatgggtttacgttatctgcttcctacaatatgttctccaatgcatttgaactgacggtcaaagggaaatgttcttataagctggagatcggaaaagacccggtaggaaatatgcagcgtatccataacacccttttttccattgacaggaagctgacggaaagtgagcagaaattggaaaccgtacaacagcagcttgcgactgcacaggaagaggtaaagaaaccattcccgaaagaagcagagctgaatgaaaagatggaacggttatccgagttaaatgcgttgctgaacatggatgaaaagggcaatgagacgattatggcagatgaggatattggcagagaaggaagtagcacagatagcagggatgctgtagaagaaaaagaacttccggaaacagcagacagaatccataagccatctattctggaacgcttaaagcaggagaaggcacagcagaatacagcggaacagccacctgtacagaaaactgcaaagaaaaaacacgaacaggagttataaaagatttcccgtcagagttttctctggcggggacataaaatggagggtttgtttatggcaaataatatagagaaacagttaaaggaaatatcggaacggctggaacagggcgtaaaggagatttttacttcggaacgatatacggaatatttgaataccatgtccaagttccataattacagttttaataacacccttctgatcaccatgcagaaaccggaggctactctggtggcagggtatcaggcgtggcagaagaaatttaaccgccatgtaaagagaggggaaaaaggaatccagattatcgcaccggcacccatccgtgagaaacaggagattgaaaagattgaccctgtaacaaaagagccggtgatcggggatgacggtcagccggaaacagagattgtggagatggtcattccaaggtttcgtgtgacaacggtatttgatgtcagccagacagagggagagccgattgtagagttggaagtaccggaacttaccgggagtgtacagttttatgacacgtttatggaagcattgcagaacatttctcctgtgccaatccgcatgatggaaatagaaggggaagcaaaggggtattatcatcagacagaaaagtatatcgcaattcaggaagatatgagtaatcttcagaccatgaaaaccggagtacacgaagtaagccatgcattgctgcatgaccgggaggtaatggatgcggaagggattttaaaagaccggacaaccaaagaagtggaagcagaaagtattgcctatattgtctgcaaccactttggtctggatacttccgaatactcttttacctatattgccagctggtgtgaaagcaaggatatgaaagcactccgggcatctatggataccatacggaaaacgtctgcggaagtcattgagaatatcgagacacagatgcacgagctggaaatggaaagaccagttcgggatacttttcataaggaagatttaattctgcatctttcaggcagtatgggttccgagtttacttatgatctgatcgaaaacatgagcagggaacagttagagcagaatgtgggggaatacgtccgccttctggaaagtggtgagatagaggaaaatgagaaaccactggaaagttttctggaagaaaaaggtgctgccgtcacaccactctatgacagcagtgggcacggagagaactatccgattgatttttatgatgtggaatatgatgctgacacaggcgttacttatttttctgacctttctccgaaagatcaggcagagatgctggtgcaaaaagcagagtttccaagaaatattttttcggaaaatgaaaaggcatttgtaaatgaatatgcagaaaccttccctggacaggtggaaagactgaatgacctggtatgggatatgagggaatcttacgatgaagccggttcaaagctggtgtatgaagtgatccaggcagcaagggcgaacttccaagcgaaagagccggaaattgcagaagaaacagccatgcagtatgcccaccgtctgattgaaacagcagaagctgccaatacgggagatttcacagattcccagagaaatcttattgtgaattttgcatataagatggatgataaagacgaagtgcttggactggtgaaccgtatgatgactgcaatccgcagaccgggaagtgaatatacgagaagccttatgaatgaaatacaggcacagattgacaatttcccggatggcatggttggttttacagaaatgcacgaggcaggaatccagttagaccatatgcttccgcttacgaaagaccgtgcatatgaattgtaccgtggaggggcagaaatttatgtgttacatggaaatcaagagaatccacagctggcagaatcaacacttgtagacacagaagatgcaattcttggatatgacggtatctttggaatcacagaaacagaatgggaagtgcagaaagaaagagaaatatctgctacaaaacaggaagcactggaacagcagagtgcagaaaagattgatgagacacttcttctgcatggagaaagcggaaggtttgccatttatcagatggatagtggggatgagcatacttatcagtttatgggaatggaatccgcaaagagtctgggatataccattgacggaaaggattaccggatggtttatgcagcaccatggatgccaacaatcacgttagaaaatatatttgaacgctttaacattgaccgaccggaagatttccgtggtcattctttatcggtaagtgatgtgatcgtgataaacaggggtgcagagattacagcctattatgtagattcttttggatttcaggaacttccggagtttgtccagcagagaatgaacatactggaacataattccgtcagggcatatccgccagtttataaaggaacattggaacaggcaatgggagaacgggatgtggatgcttatctggatttgagaaagttaaacctggactgcaagaaagcaatcgaagaagctatccgggagaattttgacgggctgcacttaaagcagaatgcagcaaaagaagtcgtggaacgctttggggaagaacgtatgaattttgttatggcaaataccatccaggaactttcccatgatggaagattctccagacagaacaaagactgggcggagcatattgaagtcccggaaaatatcagccggggcagaaatctgaatctggattatgtgatcgaaagccacccggcagttttagatgggtttatcgacatggcaagagctgagattcggatgcagaggatagaacaggcgataggagaaaacgaagtgacgattacggcagagacaagagggtatgaagcagaaggacataacggaacatggcatacggttgatgaaaaggaatatgccggggagaagtttttcttaatggaacaggatgaatttggatccgatgtggcaggcattatcgtagcagaaaatggacagcttgtagcggaggacttatggaacgggtttgacgcaggagcattggaagcagtttcagaatatttgcaggaaaatggaacaacactttatgacttgacggaattcccgaaagattctgttgtaaccctgcggagtggacagacacttacaatcgaagaaatacaggcagtacagaaagatacctgggaagaaacgatggcaggaaaaaatgaatctggaacggatgtccggtttaattttcatgcagtcagtgaggtgcagctgccggaaggcataaagttaaaaatgccagagattcattacgttgataatttttatgtgatggaagatgtaaatgcagagggtgtagtaaaagtaaaccggtatgaatcactggatgaagcgatgcaggaatatttacgtctgccaaatcatcagaaaaaagtgcttggtatccagaatacggaaacgatgcaggaaagcatggattttatccgatgtgaaaacgggatagatcggctgacccatgcgtataaacagatcggagggtggctgaatccagaaatatatgaagtggtaaataaaatggaaaacatgctggactggaatgaggtacagattgcatatcagattggaaaacaatactttacaatccagaccgcagaagatggttatgactatacattttataatgaagattatcaggaggatgatggaggaatctatgacaatccgacaatctatgtagatgaagctgccagtgatattttagaagataaagggtactcactggaagatgcaaaagtagtggattacgaagatctgatggcagatgtggaagaagttcaggaagaacagatgcagcggatacaattagaaaagaactgcccggcaagtatttttgaaggatttcgcagggaagaagcaatgcaaacctatgaaggaatcgcaatgcagtttaccaggagtaaagggtatctgaccatacaggcaacagaagaaggatattcgtttattttttatgactctgatctgcatgaaatccagagtggtgattacgataatccagacgcatctattcaggaagctgcttatgaaatccttaaaagtgaaagaatggatgatatggaatgtgtcaaagtggattataaagaatttgaagaaatgacgatccagcactctaaagatttattgcaggaaggggaacttcgtgcgacttctgagattggaagaaatgaactggcattaaatagtctgagcagggcagaagtagaaagaggggttctgtatcatgcacaggcagtattagaagatatgggaatggaacaggaggtagagctgcttgctgcaagagtgtatggttccagaagcagacaagacctttaccgggaagattctgaccttgatgtggttctttcctataaaggtgatattcgagaagatagctttttcaatgccttaaatgaatctggtatagcgatggcaggaattaaggtggatattaacccgattgcagaggagcgaatcactctggcagagtatataaaagaatccgaaaaatatcttgaccagcaggagattaaaaagctcgctgtggacctggataattttagttatgacattgatacctatgagtataacgatacggttgaaaatagagaagaacaggtggaaaagctcacggaggatattttgaataagaaaacagaagctatcaaggactggctgattgaggtatccgaggaatccgatatagacagcgatgttataactgcccgttctttacttttccgtctggaagatacagagcaactttctatctttgataaacagccggagcaggaacagccagaagccacgatcagtttttatgttgcagagtgcatggagtttccggtcatgggagaataccataacaacctcactttagaagaagccattaaaatatatgagagcattccggcggaacggatgcatggaatcaagggaatcggatttgctctgcaagatggtgatgaagattattccggggaatatgagttgatgagtgcagaccggatacggcgtgatctgatagatatgattcctcactataaagaaagtcctctggtgcagaaagcaatcgcagacatggaaaagtatctggatgaaaagcatggaagggtaaaggaaacggaacatacggtagaaacagtaataggaagtggacagaaaccttttgcggttgcggcagacagaagggcagagcaggaaccggtatctgtaagtcagagccagccacaaaaggcagaacctgcaagcagagcaaaaggtgaagtgaagaaatctgtgctgcagtctttaaaagattttcaggcaagggcaaaagcacaggagcagaataagacaacggagaaatccaagacacataagaagggagaagtggaattatgatggatctggcgatgaactttgatgcgaatgaatgtttagtaaccgcaatgtttgataaaggaaaccgaaatgacacgatggaggcaatcgaccatatcattccttttctgaaaggcgatgcagatatgattgggcttgtctgcaataccataagaaaactgttctgtatgagtgatgaaggttatgaagtttttcttatggatctggaagaatataaaatggaactgggagaggaggacgaagaatgagtacaagtcagtgtgcagtatatcaggtaaaagataccccagagtaccgggatgtccgtttccgttcttacgagaaactgaaaagcgaagaaaaaacagtccaagtagaaaactatcagcaggtgtacattggaagaatccagccggaggaaactccggctgacattaaaacacgcttgcagaagcaacgaccgaaaaactttaaaggtcattccatcggttgcagtgatgtgatcgtcatcactgatgatggaaaaaccacagcttactatgtcaacaaagatggttttatcatcattccggaatttctcacaatcaaaagttcctccgataccagactttccattgatacgaccggatatgaaatcgaaggaaagaaaggaacatggcttgcacaggattacatcctgatgaatgaaaagaaatggtttctgatggaacatgaggagtatgggacaagagccgcttatgtgattcttagtgaagaaggcaccgtagtcatgaatgattgttataatggctttgatgaagaagccagacggaatattcagaacttcatgcagcaacaggcagagcaggcacagaagaaacaacaggaaatgcaggcacaattccagaccggacagctacaacctggagaaacacaaaagaagaaaccagagctggcgaactggcagaaggtcatggataatggagaataccttcgtagtgcagagatgacagaagaagccaactataatatgattgacggactgatgaataacactccaaagaaaaaggataagaacgctccacggagatcggtacttaaacggctccgaaatcatcagaagaagatagccagtcaagggaaaggacagccacagcaacagaaggcgatggaagaagagatggaaaggaagaagaagtaaaaaagtcttgccggaatttttgagggcaatatataaaaaatggttgattttttctctcaaatatcatatcataatactaacaggactccccgcacctctcacgcaagtgatgtgtcccatggggagacatttttatttttggagaaataatggtgaatacaagtgaaactaaaaatgaaaagttgcaaaataatgaagcaactgtacaggtaatgaaacaaccgaaaacctttgctcaacaagtcgaaattattaaagaaaagggttttattatagataatgatacagaatgtatcggatttttaaaacaggcgaattattatagattatctgcttatttccttccgtttagaaaaaaggatgggacgtattttttaaatataaactttcacagaattcaaagaatctatgaatttgacagtagattgcgtggtgtattatttaattatatagaaaaagttgaattatatttaagaacgcaattagcctattacagtggacatgttcatggggctttaggatatatggatggggctatttacaatgacaggcacaatcatgaaaagttcgtgaaactgttaaatgtatgtatagaggaaaataaaagtacatcagtagttcagcaccataaagaaaagtatggcggaaattttcctatatgggttattgttgaatttttttcaatgggaatgttgtcctacttttatgcggatttgcagtctggtgaccagaaatatttagcaaaagaattatatggtacatcagtggcctgtttaaaaagctggttacgttgcatcactgatttaagaaaccgttgtgcacattattcaaggctgtattattggtcatttcccgcattacccaaaatgccaagggaattagaaatgtcaccaaacagaaaattgttttcacaaatacttgtattaaaattattatatccaaataaaaaagaatggatcaacaaagtcttgatagaattaaaagctattgtagaagaatatgagaatgatatatcattgagacatatagggtttccagaagattggtatgagcagttagaaaaatagagacatattataagggacagaggagtaatctgtccctttttttaatatgaactataaatttggctcttttctaccctgtagttgctgctcacgattcttcccaagaatcatatcaatattcgcagacacagtgcgaagttcccgttcataatcccgatgattagaaaaatcttcacgctgtctatccctcaattcaacaagtcggtccttttcagcatagagagatttcatggaaggtaatttattcccgccagatttttctttgagtgttcggagggctgtgtcatacagggaaagttcagcccggtgttcttcagaaaatttctgtttgtttcggcttttacgataatcggcgtacacatttttatatgccagatattgtccggtaaaatgaatctgctcattcacatctttaagttgctgttcagtatcttttaaagattttctggaagcactggtctggtctgaagcctgatcgagtgctgcatggaaatcatcaagagaatcatagccatgttcctgtatgtaggcaacagtctgagccatctgctttaaattggtgagctttactttttgagcataggcttcgctctgctgtgctttaatacaggtttgcagatctatgacaagacggagatctgattttatgaaaatgaacggtgctggtatagcagaagtatcggagaaaggaacggttggtaaatttgtggaagtattcggagactgctgttccagaatttcttctttctgttctttatgggattttgtgttttcctcaaatgctttcaagagaaaatcttctgtgtatctggttccaagattccttccagtgatatatttttttctgccaggatgaagatagctgtagcggtttcgactgatcttgaagatgatgtgatatttttcatcaaggatttttgaaaattcctctggtgatctggcggtacttgcagcatcatcaatcgcatctcggagaaattgtttctctgtctggtaacgagtttcctttggtgtgattccatcttctttcattttctgatttagcttatctaatttttcttgtccccggcgttgtgcccagtattctttttcggtgatttttctttcagcaggagtgagcagattaacttggtgcagcccttcttttttgcacatatccatgacttcctgttttagatgggcaagataggcagcacttagatgatgcttataaccggcttttgcttcacagtcaaattccatatagggttcttgtggtatatcatatttacggagactgttaattacgatatgcacatggatgtttccacttttgttatgaccgtcggtatgagtacagactaaagcctgatgaccgggaaagtttttctttgcaaaagtcaatccgagttgctgggcacgttcaccggtcaatccacattcatccctgtcttttgggtcgaagctgatgatatagtgatgggattttatttcattgaagtttttgttcttgtgatagtagctgttcagttcctgacattcagatgcaaaagagaatggatcacagttcagaccgtccagataatattcttctctcagtatcatatgcccttcttcatcaagaatcggtttttgtgtatactcgttgtgctggaagataagatatcgttccgattctccatagtcagagtttttgtttgcgatatgtttaattactgccacgaaaatcacctgccattttcatcactttatatttcatttcataaatatcccggagagactttcggatttcatttctcatttcagaagagaggattccaccctgattaaaatatcgggcaatctgatttaggttgctgccaattttaccaaactcgctaataagtttttttatttcgggaacatctgcggtaatttcgtatttgatgatgactttctggttgaccaaggcatttcggataaaatcagaaaccgtcatgctgttagccttggctctttctgcaagaagatcatattcagtttcattcatgcgtaaatgcacatctttagtttttgcaagagtttcctctttcttaggtcttgtcattgataacttcctttcttcgtagtagtggtttcataagaaaatccaaattttgcggcctgctgggaaagtaagtgatgaaaaattatcgcactgtgaccatgtaaatggaaactaatacacatatctgtgattgtggtcgagggtatggggaaacgaaatccccatcaagttgcaagtcgccaagaacccggaaaggggttattgtgctacattgcgaaacttgctctaagaaagtgacggcttcctctgtgtgggcttttgctgatacctccggtgggcggggcgtggattctgccagctatgcggcgggatttctccctctattacttactacgcacggcaaggcaaatctggcaaagttccccggaatttcttttcgtgttttcgtaacagaatttgacaaaaacggaagaatcagttccgttttgcagtgatatacggacggtttcaaaaaatgccaaactttccggcaattatttttccccttactacctactacgggaaaaaagaaaatttaggcaatgttttccaaaagtatttgaattattttattgcggtgcaaaatccggcttggttttgggcgcaaaaaaacaggaaaccttttcttgatttcctgtctttggctgccgctgatgggcggcggttattctgttatcattccccggaagcaaacttgtagcccacgcctaaaacggtctttatgtaagtgggcttgccgctgtccgactctatctttttccgtagattgcatatcacatttgccacgtttgactggcagctttcgctttccaggctccacacggcttcaaagatttgcgcctttgtgaataccctccccggactggtggcaaggcagcagagtgcgccgtactctaaacgtgtgaggggaatgtctgtgccgttttttaatacccggcgttggtgcaattttatttccaatcccggaaaagtaagtacgggggagtggggcggctgcatggcttccagcggtatcatatcagcaagggcggctatggctttctcaaccgctttttcttctgtgtcgttaaatataagcatgactatttttgcgacaaatctcacctcctgttaggtaggctgtccgtcaaagcggaactggaacagggcagcgataagccgccgtttaatgttgtcctctgtgtccttgttgacctgtccgttttcaagggaagcaagccggattcgcttgctgtaatgccgcaaaacctcgtcaatggcttccggctctccgctggtcgcccggacaatggtttcatacggtacaagtttaggattcctcatggaaaagcacctccatttcttcatgcagcatttgcaaggcactgtgtatgtgatgccacgccgtactccggcagcgtccgtacagttccccgatttcctgctgtgtgtaacgcccgaaaaaataaaggtaaatgatttccctctttttctctggcagagaggacagggcttcggcaagatttccatttgtgaggataaccctctgaccgcatatcgtaacagggtattgcttgtaagggtctatgaaatatgtgtctgacgtacaaaatggataaaacttttcttctgtgagatattcaaaggatatttccctttgccgccgtttatccctgtcacgccatgcgttgattgctgcatagtgtatgacaactctgcaaaaggcattaaaggtgtactcgatatgctccttatatgcttctgtgcaaggcataaatagttccccctttctcccacataatacggcgtatggtttataagacacttgttatttcaaggtttctactgtgaatgaagcagaattgcccgaattattatcccgtaaaagtttttgtgcttccgcttcggaaatttccttaatctccataactccattttcactattttcagcaatggaaagatatatactgccactgttattaaaatagatgatgggttttttagtatcaatgaatataccaattatctggtcgttgtagtaccaatacccatcttttgggtgataaactatgccataggattcataatcttggagcgtattcatgttttctgtcttatctccagattccatgctgtaagattcatgatttctaatcatatctccattttctgtagaagtgccagcgggcattgatttaagtcctgaattttcatacttttctgtatgcctgtcataaacttcttttgtgcattcccgaataccaataagtttatcgtttgtatcccgttccgcttcaatatccactgttcccgtaaagaaattggtaaaacttgcgccgcccactgggtcattaaaaaatcggacaacatttcccttgtaagtgtagcacttgctattcttatcataaatcaatccatattcttcatatatcccatagtcaatattaccgccgggcagttctgccgccgtatcgtaatctgaagcattctcggaagcatgtattggtttgtactcctgttcttcaaaaattggattattattagcttgggcggaagttgcaaatgctgtagctaccccgacaacaatcagacacgccagtaccagcgaaaaaatagttgttttttttgttttcataatagcagttatcctttcttcgatagcatttttactaaagctgttacaaaatggcaatagcccacttttcgttgcttccatgttgataagcattagcgaataggcagattttgatttttctccaaattgtcgtatgacgctttcatcacaagccagttctatatcacggttaaaaagaatatacatcacccacacaaaggggttgaaccaatgaatacaaagggcaagtgtcgcaatcagctttgttacagtatcatagcgataaatatgcacatattcatgtgagaggacatattgcagttgtttttcatttttccagtccatttttttcggcaccaaaataacaggacggaaaatgccataagttaatggggcggaaatcctatcagattgctttaccaaaattggacgtttcaatgggcgttccgccagccacttttctacataatggttgtggacgggtaaagctgtccgaaattcaatcagacaacgcaaataggatattacaaaaaacaatgcgataagtattattcctgcacaccatacaataaaccacatggaaacagatgataaaatattctctggcggctgttctgctccctgtgtcgtaacaaacagcccttgcatagtgggaatgttgtaatctgttccagcttccggcaatgttgtagaagatatgctatgagttaccaacgtataaacactaaacattgacggaatcgaaaacgggataagcagtcttaatatcaccaattcccataaaacaagaaaagtctttttcggcagtttattgattgccaccgcacggataatcactaccgcagtaatgaaagcagcccccgaaaagctcatttgcagtaaattcatttacaccacctcattccaaatcttccacaatctgcttgagcttctgaatctgttcagcggaaagcttttttctgcctaacagggctgcaaacagtttgtcaactgaaccgtcataaatcttgtcaaccaattcttttgtttccgcttcctgtacttcttctttgggaataagggcatggcacatgaaattaggctcggaacgttcaatcgccccttttttgatacacctttttatcagtgtgtaggtagtattcatgttccagccaatttcttttttcagaacgtcggatatgtgttttgcagtggtgtcgccctcgttccaaagcacacacattactttcaattctgaatcgaaaagtttaatatccatttgtttcctcctttccacaagaccgcagtagtttctgcttgattacacattacacctttcttaatcggttgtcaacactaccgcagtagtgttaagaaaaaattcataatttattttcttgaatagataatgaaatgagagggcttccgcagcagtcggcactgtgcgtaatgtgcataacttgctatcttatggagttgtgggaaagtccgtttgcagaatgtgggaaagctgctctttagcttttccatgttctgtgaacggacttttccataacggaatagcaagttatacacatttccatggtgcttgtcgtttgctctttggttcggaatagtgtggtgctggcggtctatctcttgttttcggttgtttgcttctttactgtacatgagcatttggttaaggtatataactcactcaataaaggatatttttttaatacttcctgatactgtttgacagtgattgttccaatatcctcgagttttttataaaccagctggcataaggatttcctttgcacatattcagaatgcggcttttctgtttcattctgttcatgcattcgtgttctttctttttgcataaacattcgtaacgaagctacactgccagtatatccctttttacaaataatatcatgtatttggggatacgttaatccctggctcctgagttttattacctcgttctcatatggagctaattttcctggaattcgaacattatagtgaccatttgtaactgaaaaatcaggatttaaataattttgtatagtcttatgggcacggtgcatctgagatgcaatctgctcaatcggatatcctgccaaagccatttctcttgcttcttttatttcctgttctttttgttttattgccagctggtgttgccgttccctggcaatttccttgctttctggaatctggtcttctggaatcacaagatatttttggattgttttaggtgatgaatgtaacaataatgctatatccgatatggtcagtccttccctgcgtttttcatgggcgaattttatacgcaatgaccggtttgcagtgttatataatgctttcatttcatccgtaacgctttctgttaatggtatttcaatcttaatatgaaacagctttcagaaaaaatagcaaagtatgttataaaaactggtgttgtttccccggaattatatgtagtatatcaatatggctttcagattggacttgagatgctatgctgtttcgtaacttgtttgagtatagcaatgtatatgcatatgattccggaattcgcaatatttacggggatttttatgttgctacgtacttatgcaggtggcgtgcatcttaacagttttggatcatgttttatatgttcagtcactgtacagacaatagcaatgtattttaacagtaaatataaatttacggtaggtacagcatggcttcttatattagtaagtgcgatattgatattgaaagctgcaccagtagagtgtatcaatcgagaacttgatgatgctgaaaaagaacactgcaaaaaagtaaccatgaaagtcttaattgctgttattgtatttgctggttgttgtacacttgcaggaataccagatatactttccttagttgcactgacttcctttataattttaatctctcagtatgttggtattttgaaatataaaattgaaaagagcaagaataagcggagatgataaaaattgtttccgctttttttattatatggaatggaggaagaaaattatttttgaatattagattatttatatgaaaacgtccaatggatttcaatccataaggacgttttttgtatatcataagaacttttttatagagtttttcttttaaacccgaacaatgggggcttcccaatcgggataagggtgaaagggaaaaagacctttgctcatatctcatggtcgggaaggaggtgaactctatggagcaatcttcttcctacgatgagaaaacggtaatgcaccagtttgatcgaaaatgcaaattggcattaaagggcgaaatagtggattatgaaaggcatttagcttatcttagaaaacacgaaactttgttttcagaattatctgaacaagagatggagagcctttctatatttgatgaatatgaattggaaaaaagctattttcgggcaggcggttatgatgtagaggtaaaaaatgctctattggcagaagcattaactgcactgacagagagaaaaagggacattattcttttgtcatactttatggaaatgaatgatgcggatatagcaagaaaactgaaccttgtaagaagtacggtacatgagcatcgtacacgatcgcttgaaatattaaagattatgctggaggaaaatgcaggtgaaaacggaagaaaaaaacgtaaataataaaaaattgataccgttttgggtaatcgaaagagcattggagggtgacattcaggcgataaataaaattctgaaacattatgaaggatatattgcaaaattatcggttagaaaaatgtatgatgaatatggctgtgttcattattgtgtagatgaaacacttcgcagacgtctggaaacaaaattgataaaaacaattattggatttaaaatagttcgctaaaaaacatttgaaagcatccctttctgctgaaaaagctatttagcgttgttttgtaccttgaaaatttaatatttatcctgcaggacagatgaaacagaggagctggacagcagatacgccaagactgtctgcattataactttgcgacatcgtgacgcaaagtgaaaatgttgtaaacgaagaaatatcaaaatgatattgaagtaaaggcacgagcgataaatatttgactgtgatcaggaagtgggacttttgtggcgaagatactgtttctgataatgatacttccgggaaagctgcccggtctgaaaagatggtgaaataccaatgaggctgttacccgacagctacctgcaggattatctataaataaataaggaagggaaaatgaacagtacaaaattattaagatatagtatgcagctatccatgctaaagcaacttagatcattaaaacttatcaatgaaaatgaatatcgcttaatagagaaaaaactaaaaaaagattatggtgtaatttccaatattactgcttgactagtacagagttgcgttgtagaataatattaacactacgataggaatacataagaaaggaccggtgaaatggaagttgaaatcattaaagcgaacagttctgatgaagatatttctaatggaagaaggattgacagattaagagttgccgcatattgtcgtgttagtactgatgatgaagatcagattaaaagctataattcaatggtcaggtattatactgatttgattaaaagtaataaacagtgggtatttgccggagtctttgcagataaagctatcacaggaacgaaaacagataaacgtgaagaatttcagttactgattcaggaatgcctttcaggaaatattgatatggtaattgcaaagagtattccacgatttgcaagaaatactttagacacattaaaatatgtaagaatgctaagagaaaggaatatagcagtatattttgaggttgaaaaaattaataccttaaaggatggggaatttttactgactattttaagttctgttgcacagcaagaggtggaaaatacatctgcatatgtaaaaaaaggcttaaagatgaaaatgaaacgaggagaactcgttggatttcagggatgcttaggttatgattatgatgtggtgactaaatcgctttctgttaatgaagaaggtgcggaaacagttcgatacatatttgatagatatgttgcaggagctggaagtacgatgattgcaagggaattaaacgaacagggaatcccaaccattaagggaaatccatggacctcttccagtgtgatgggaattattaataatgaaaaatataaaggagatattttattaggaaagacttttacagtagatccaatatcaaagagaaggttggaaaatcttggtgaagaagataggttttatataaagaaccatcatgaagcaattatatcagaggaaacttttgcaagagcccaggaaatacgagaacgtcgtaatggaggacgtaaaaagggagttgcccctgggaaaagagaaaaattcagcagacagtatgcatttagctgtatgttggagtgtggattttgtggtgcgaatttatcaaggcgaaggtggcatagcagctcaaaatatacaaaaactatttggcaatgtgtggaatcaacgaagcatggtaaaaggttttgcccagacagtaaaggaattccagagcaggttatagaggatgcttttattgaatcttaccgcatgttatgtatggatcataaagacgtgttggaggaatttattaagagagttgagaaaactttattggaagattcgatagaagataaaattgaaaagcttaatagaagcgtttataatattcaatacaagagaaaaaagttgctggaaaattatttagaaggtgttgtggctaaagacatttatgaggaaacagatatgggatatgaaaagaaattgtctgaagcaaaatcacagctgagtatgttggaacagcaatatgacaatgagggaagcttacaaagaagacttgcagattttaagaaggcattgtcaaaaaatcaagtattagaagaatttgacagaggaatatttgaaagtatcatcgaaaaagttattgtcggtggttacgatgaaaatggagagaaagatccctataaaattattttcatatataaaacaggattcaaaaatgaaattggaaacgcaaaagaacgatttgggaagaaatcaaaagcagtagaaacagtgaaagaaatgtgttcccatatcgtagacgaggtaaaggatgtgtgttcttatgttagtgacaacacatgttgaaactgtcgcatgtttgaaaaaggtaaaatagtaaaagcttttgaaacaaaaatgataaattggaactttatggggagatttcaatgaaaatccatattataggaggaagcggttctggaaaaacttatctggcagacaaattatcaaaagaatatggtattacacattatgatttagatgaactgcaatgggataataaagcagattcttatggggtaaaaagaaatgcagaagaacgacaggaaatattggaagatattcttgaaaatgagcaatggattatagaaggtgtttattataaatggtgtaaacagtgctttgcagatgcagataagatttatttattgcaagttccaagacgagtttatatttatagaatcgtgaaacgatttttgaaaagaaaacttggattagaaaaaggaaaaaaagaaacgataaggtcgcttattcatttaatcaaatgggcggatatatatgaaaaaaatgatatgattgagataaagaaaattttagaacgatataaggataaggtgatgataatatgaacttaacaagaaccagttgttttttaagtctgattttacgccacaagccagaaaccattggtatcagtctggatgaacatggctgggcgaatgtggatgaattgattgagggcatttcaaaaacaagagaattcaatatggatattttagaagaaattgtccggacagatgagaaagagagatattcttttaatgaggacaagactttaattcgggcgaatcagggtcattccattccagtggacgttgaattagaaaaggtagaacctccagaggaattatggcatggaacaggtgaaaagtatgtttcttcgattgatgagattggtctgattcgcaaaagcagattgtatgtgcatttatcaaaggataaagaaactgcggttaaagttggaagcagacatggaaaaccagtgatttatactgtaaaggcaagagaaatgtatcaggatggatatgagttcttcttatcaaaaaacggagtgtggcttacaaaagaagtaccggtgaagtatttggaaaaaatagtaaaagaataaataataaggacagagaaaatggttaaaaaaccagaaaactctgtccttattttatttgcgatattgttcaataaatatataaaataaaccaatgaaatcagaagaaatttataatataattcaagaaaaagaaggagagtgagtaaatgaagtttgatattatgaatgcaaatgtaaaaatagaaaactctcaatatgggaaaaccctttccatatatgttgatagcaagaataaagtgaatcaattaatgataaagctggcagatgcaggatttgttgttgattatgagccacgttatgaaatgcagaattatgagggatgttttctatacgaagatggaaattcaattaaagtttgttacaaattgtagaggagagaatgatatggaatttaattggttaaacaaaagtgaaatggaagttgaagaaaataaaattaagatatatgcaccaaaagaaagtgatttcttttgcaataatggagcagtgtcagaagagggaattacaccggaatctttgagtaatgctccattctattatacagaagtagaaggcgattttgtattaagagtcaaagtgtcccatgattttaaagatacctatgattctgcgtctctgatggtaatggaggatatggagaattgggcaaaaagctgttttgaaaaaacagattttgatactcatgcggcagttagtgtggtcactaaaaatggtatgtctgatgatgcgaatggatgtaatatgattggaaatagtgtttggcttcagatttgcagagtagataattcttatgcttttcattattccgaagatggagaaacttattatatgaccagattttttaacctgtcaggacagaaaaaaattaaagtgggattactggcacaagcacctcagggaaatggaggaattcgtacctatgaaaatctttcaattgaaaaaagaacagtaaagaatataagatttggaaaataaaaaacgatagggatatttaaaattataaatttttattaaaatattagcaattagcaaaaattttagaatctaatattttaaaatagacgaaaaaagtaccggaaaagaaggacaaaagctccttttttatccggtactttttgttgtcatattatctattagttcgtttatagtttactaaaaataaaatatacttgactttttatcggataaatgataccttagagaaaagaaaagccggaggtgaattacacgtgtcaaagaatattgctattaaagtagcaagagcagaaaaagatatgacacaaaaagcattagcggaagcagttggggtttcaaggcagacgataaatgccattgaaaaaggagaatacaatccgacgattaaattatgtcgaaaaatctgccgtgtgttagaaaaaggtttagatgatttgttttgggaggatgaggattatgaagaagaataaaagtaatctggatgaaagacaggaattaaagcttcttaaaattgaacataatggatgctggtttgctttttggggattgttagctgtgatgttggtgcagctgcttttaggaaataacgatgcaaaaaatcttgcaggggaatggattgtgtttatgagtttatgtgtctatcttttgaccgcttgtattaaaaatggtatctgggacagaagattaaaaccgacactgaaaacaaatacgattgccagtttgattgcaggtattctgaccggaattgcctggttcatcatttcttaccgcaactatcataaatttgcaggggctgttgcgacaggaagcattatgtttctttgtgtaggtggtttgtgctttgccggattaacagtattttctggagtctataaaaagagagtgaaaaaactggaagaagaatctgaggaataaatcataccagaaaatatgatagctagaaacaaataccattcatcgtggaaaggggataaaagccatttttcacggtgtttttttgtctgaatttttgctataatgcgagttgaaatcgtatcaaaaatttaagaagggaatttaaaatgaaactagaaaaagacagtattttttacagaaaactatggagtctgatgattccaattgtactgcaaaacctgatgcttgcaatggtcgcagtagccgatgcgtttatgcttgggggaatgaaccagaattatatgtctgcggtttcactggcaacacagattcagtttatccaaaacatgtttctggcagcagcaacagcaagtcttggaattttgggggcacagtactggggaaagggagatatcaaaaccttagatgatattttctgtatggcacttcggctttgtggcatggtatccgttatattttttattggatgtgtattctttggaaagtatctgatgttggtttttacgaatgaatctgtactgattgggtatggtgtgagctatctgaaaattgcaggttgttcttatctgttaaccggaatttcgcagtgttatcttgtcattatgaaaacaagtgaacatgcaaagacaacggcaattatcagttcatttaccgtttgtgtaaatattattttaaactggatatttatctatggtgcatttggcttagaagcaatgggagtaaaaggtgcagcacttgcgaccttagtggcacgtattttagaactgggctgttcgattgtgatttcttataaagacggctacattcatccggatatgaagcggttgttttatcgaaataaacagcttgcaaaagattttcaaaaatgtgccctgccgcttcttggtgcgtgtttgttctgggggattggatttacgtcttattcatcctttatgggacatctgggtgttaatgcggcagcagcaaactctgtggctgcggttgtgcgtgatattatctgctgttttagtgcgggtatttcaagtgcagcaggaattatggttggaaatgaactgggagccggaaatttaaaacgaggaaaattatatggaatccgtttattaaaaatttcactggtctgtggtgtgatggcttcccttttgatgttggtgactgcaccgattattctgcatttcgtgaatctgactccacaggcagcaggatatttaaaaggtatgtttggagtgattgccttttacatgatagggcgttcggtcaatgatgtcacgattaatggaatctttggagcaggtggagacacgatgtttgatatgtacagtcttgcagtatgcatgtggtgccttgcaattccgcttgctgcacttggtacttactattttcactggccagtcgtagttgtgtatgcgtgtacctgtattgacgaagttgggaaacttccgtgggtatttttgcattttagaaaatataaatgggtgaaggatttgacacattaatttagaggtgattaagatgaaaacacgagaagagattttagcttatggattaacatttgcggatacttatgtggatacgccgttttctgatacaaactggcagcttgtacgggtaaagcaaagcaaaaaagcatttttgtggacttatgagaaagatggttttttgaatttaaatgtaaaagcagacccggagtggcgtgatttctggagaagcacttatgagtctgtaattccgggatatcatcaaaacaaagaacattggaatacgattattttagatggtagtattccggatgaagatgtaaagcgtatgattgcagaaagttatgatttggtaacggacagtccgacaaaacgaatttacgaagcagtgaaaaaaattcctaaaggacatgtggcaacgtatggacagattgcagagatggcaggaaatccgagaatgtcaagagctgtgggaaatgccttacataaaaatccagacccacttcatattccttgttttcgagtagtgaattccaaaggggagcttgcaggtgcatttgcatttggcggaggaaaagcacaggcagaactcctaagagaagatggagttgaagtcgtggatggaaaagtggatttagagaaatatggaatgaaatagtttaagaaatggtggcagatgtcgtctgagatatatttatagaaaatagggtaaaaataaaaaggactttagctgaaaaaaattttcggttagagtcctttttttacaagaaaagacagttcgatatggtatgattgtaggaaaaaataagatagaaaaaagaataattgaaagtgagtagaaagaagaaaagaatgaagtcttggaaacaaaatccttcagaaaagaaaactcaaaatcaattagaaaacagagtcgaaaaagaaacaaaagaaaatcagtttaatcgtgcagaaactatttttttaaacagtatttcacatgatataagaacaccattaaatataattatcggatatacggcgcttgcatctactcatgttaatgaggcgcaggaggtaaaaaaatatctatcgaaaatagagacagcaagcaatcatttactgttattaataaatgatgttctggatatgagtcatattgaaagcggaacgctaaagcttgaacacgcaccagtgtatttaccggatgtgctggaaaatttaaaagcaattattcagacagatagttctgcgaaacagctgaaattttgtgcagataccaaaaatatggtgcataaaaatgttattacggataaacttagattaaatcaggtattattaaatatcttggaaaatgcagtaaagtatacaagacctggaggaaaaatttattttcaaattcaggaattaaaaggacaagagccgggatttgcaaaatatgaatttcgtgtaaaagataccggaattggtatgagtgaagaatttatagcacatatatttgaaccgtttaccagagaacagacctctacagtcagcgggattgaaggaatgggacttggaatggcgattgtaaaaaagattgtagacaggatgggtggtactattgcggtaaaaagcagacaggggaaagggacagaagttacggtaatattgccatttaaagtcaatagtcaggtggtagaatgtgaaacgaaggtactcaaaaaaacaggtcagatgaaaatgcttagtgagagaagaaattctgaaaatctgcttaagggaaagaagattcttttggccgaggataatgaattgaatcgggaaattgcagtagaactgctaaaagaagaagggtttattttagatacagcagaagatggaacaatagcggtagaaaaaatgagaactgcaaaaccaggtcagtatgatttgattttgatggatattcaaatgccgattatggatggatatgaagcaacccgccaaatccgaaaatcagaaaatccagaaattgcaaagataccaattatagcaataacagcaaatgcatttgaagaggatagacaaaaagcattggaggctggaatgaatgaacatgtatcaaaaccgattgatttggaaaggctgttggaggttttaaagaacgtgctgaaataacaaaagagaaagaaagctttggagcaaaaaagatagttccagagctttctttgtttttataatgagaactaaaaagtaaaggaatcctcgtatttgaaagataaaagtggcataatagagatatataaataatctagatatttatagaatgtagtaggaagatttaccgtattaaataaggaggaacaaagtatgtttattaatttttcaaatcatccaagtaaggcatggggaaaaacacagttaaatgcagcaatggaatatggtgaggtgatagatattccatttccagcagttaatccgtattcaaataaggaagaaatttataaaatttgtgaagagtatgtggcaaagattatgaatttaaatccgtcttgtgtgttatgtcagggtgagttttgtgtcgcttatggagtaatttcagcactgaaaaagtttggagtaaaggtagttgcagcttgtagtgagagaaaatctgtggagcgaaaggtaggagataatgtagagaaaacttctagtttttcattcgtacagtttcgggaatatgagtaaattttaagaatggaaacgagattaaaaaagtaaagactataagaagggataaagtttttttacagaggaaagataaactatttaaaagagtggtaaaattaaaaaaaataatttaaaataaatagtagcaacatgagatgtagtcagctgcctctgacctagaattaatgttttaaagaggttagaacttgtaaaagttcaagttgactagcctaagtgtcttgaacactacgttatttctgttatcacacctgcaaatgataccctagtttgcagctctgtgcaggctctgtaaacaactctgtgaggtaggagtagtcaacctgaagtctccgattacgggaagcagttctaacattggcgaagggtaacaaactttcttaaatagaaaggtgcaggacctgagggtagctgcaaaaggtacatattatgcgagtatttgtatttaatatgcgaggcgaacctttaatgccgtgtacgcaaagaaaagcccgcctcttattaaaagcaggcaaagctaaaatttataagtataatccatttactattcaattaaagtatgcaactggtgagaacaagcaggaatgtcatgtcggaatcgacactggttctaagcatattggtcttgctgtgacctctgaaaataaggttttatttaagggcgaagtagagcttcgtcaggatgtaaaatcaaaaattgatacaaaacgaatctatcgcagaagtaggcgaaatcgtaagactcgatatcgtagatgtagatttttgaatcgtaaacggtttggcaagtggcttccgcctagtttacaaaatcgtattaatcatacatttaaatggattgataaactatgttcttttataccagaatcaattcttcatattgaagttggcaaatttgatattgctaagatgattaatccagaggttcatagtatggattattcgcaaggtcaaacttatggatatcaaggagaacgatattttatttttgcaagagataactatacatgtcaggtatgtggagaaaggaataagccattacaaacacatcatattatttatgtatcaaatggtggcacgaatcgtgtcgataatcaaatcacagtttgtaaaaattgtcataatagtacgaatcataagaatggagggattttttataaatggcagaaggaacacaagaaagttaagcagtataaagaaccaccatttatgaatgtacttagacaacaaattcttaatcaatatccacaggctcttattacatacggttttgaaactactattaaacgtaaaaatattggtttggagaaaacgcattataatgatgcaattgttattagtggaatttctactatttctgagaatttagatgaatggcttcttattaagcaatttcgtaagaaaaaacgttcactacacgaaggagtgcctcgtaagggaagaaaagaaccgaatcgtatacaaaagcgtaatagcaaaaatactccatattatcgtggattctatctgaatgataaggtgagtgtatttggaaagagcggatatattactggatttaccaatagtggagcttatgtcaagggcgtagatggtgaatatattgttttaccgaataaatcttataagcgggtaaatattgcaagtttgaaatttatctgccacaataataattggcagtatattacaaaaaatgccgtgtgattcaagatttattttatcatcgttatggagtatgaaattctaaatagaaaaggataaaagaaaggaaattcattatggattatgccacattaagtaatgaagagggttatacggtttttgaatttgaaaattatagaataagatttaaagcaccgtattccttagaacattatatttctgttaaagaatgggataatggataccttgttgtgatggcaaaatatagtcataataatgaatacgaagaggaatatattgatttaaatccaatattagaaaatttatatattccctccaatgaatttttgagtaaaataaaagaagtaagaatacaaaacacttaagaaaagaggctttacaatgaacaaacacatagaaaaagcaatacagcttagaaatgcaactccaatggtcaacaattgttctcagaccatccttcgggtttatgctgaggagcttggtttggatgaaaatcttgcagcaggaattgccggcaattttggtggcggaatgaaatgcggaagtacctgtggggcaatcacagcaggacttatgatacttggagcaaagggaatcgaatctccatttgcggtaaatgaatttcgcagacgaattgctgagaaacatgatggaatgacagactgtgcagaacttttaaaagccaatgcacagaaaggcggagcaaagaagccgcactgtgataacatgatttttgaagcaattgagctgatcgatgaattaacaaaagaagcagagtgatttggttacgagcaaatagcggagcaaattgcgaatatccgccggattaagagtaaagtaattttagaaagaaaagtaaagaacagggagaatgagtccaatgaagtatacgaaatttggtaaaacaggaattgaagtttctaagatgtgtcttggcacatggggcattggtggtgcaggatgggacaattattcagatgagagccgtatggatgcaattaaagcagctttagattgtggtattaattttatcgacacagcaccagcctataatgcaggaaaagcagaacagtatgtaggagaaactctgcataaattgggtgcgagaaaagaagttgtgatttctacgaaatgtggaaatgaatttattgacggaaaatatgtccgttgtggttcagctgataaaatcttaagagaatgtgatgagtctttgcagaatttaaagacagactatattgatgtctatctggtgcactggccagacccaaatgttccgatggaagagacaatggacgcattaaatcacttaaaaaaacagggaaagattttacatgccggagtttctaattttacaaaggaacagatggaagaagcaaaccaatattgtgaaatcgaagcctatcagccacagttttccatggtagaccgggataatgaagaattaatccgctgggcgcatgcacaggacatgggagttatgacttatggaacattaggtggtggaattttaaccggaaaatatcgtgagttaaaaacgtatgaagcaaacgataatcgaaatagattctatccatatttcagagaaccactattctcaaaagcaatgaaattgttatctgttatggatgaaatcagtaaagagagaaatgtaccgcttgcacagattgcattaaactggaccttgaaaaaagaaattatttcttcctgcatcataggttcacagagtcgtgataagatagaggcaaactgcaaagtattcgactgggaattaagtgcagaagaaatgcagatattagataaagcgattgaggaatattcgagagcgtaaatagaaaaaagagcggggaacaaagaaaacaatggaaaagaaaaagtttcaattagggaaaaagaagcaggatgaggttgttttaggaaagaaagagaaaaagaaatttatgactccgaaaaaatggaatgttgtattaggagttcttgcggtatttttctttttagcagctgtaggcaattcaggtaatgccacaaatgctgaaaaatgggaaaaatcatataacgaagcaaccaaatcgaatgatgaaattaaaaagcaaaatgaagatttacaggcaaaattggacaagcttcaagcggattatgattcactttctgaacaggcaaaggcgcaggaagaccaaaaaagtcagatagacagcttgactcagaaacagaaggaacttgaaaaacagtataatgatttaaaaacaaaaaatgatgcagcaaataagcagaatgaagaactgaaaaaacagagtgacgatttaaagaaacaaaatgaagatttgcaatcacaaaacagctcccttcagtctcagcttgcaagtgcacaaagcagtgccaatacaaatacagcaacacaggcagtggagtcctctgctccggcagtggataattctacaccaagcactgaaatggtatggattccagcaactggacaaaaatatcataataaaccaaactgtggaaatatgaatccagatacagcaagagaagtgacaaaatcagaggcagaagcaagtggatatagtgcttgtaagaattgttatcgttagttatagaataaaaacgagttttgagttttaaaggggaaatggcaaaaaattaatttgaaaaattttttatcatttccccttaattagctaaaaatctgtagatttaaatagattcaattaaataattataccgcacaagggtaatttccacttgttgtaatattttcttttttaaatcatttatagaacaattattgtcgattatggaataatttattttgtatgtttcatttttaatttcagatctatctactaaatactgagccttttcttttgtatatttgttccttttgaggattcgtgtaatacacttttctttttctgcatttataatccatatctcattaaatatgttttcaagattgcgttgtgtcaaaaaagggatatcaaagaaacataatcctgaatatttcaattcgtgaaactgattttttatttttttacctatatagggttgaaaccattcttcgaaatttttttcttcagattgatggagttcaaagtatgagcccacatactttaaatctttttctgtaaaattatttaaatctttaccgattattttacttagtcttgagtgtactgattttgaattattaataacttgatgtgaaaaataatcataatcaattgtgaaataaccgttatcttttaatatttgcaaaacggtactttttccactacctgcagtaccagttattgcaatgtaataatgtttagctttttccaaaacatagtctccttttttctgctaattcacaaaagaaaacaactttctgattttctgttccattatatacatttgagtaagctggacaccatttacagatttttctggatgcgcaatttgaacactcactgttatagacaatttgttcgtgttctttatgaaccttttttaaatgttctagtacgtcatctatattacgattaagaatagagattcctttttttcgatataatccacaaacgtatgcttcccctttataatcaatagcaagtgagtttatccctgctctacacttccatttcacattgtctgttctttgaattaattctttccattttttagaacgtaaattgttttgttgttccagtttaacaattgctttgggagacaaacattcattcaatggagtactatcacctgatgtttttggaaaaatcacaggatcatatctgaatggaacgcctaaagagtctgccattctatcaaagtgaccatttttaattgaattatataatgttttagttgctactgttcgtatgttaaagttcagtttgctttcttttaataaaattaaagcattcataactttattgtaattgttgccatttccggtaaaaaggttataatccatttcgttcgtcccatataccgttacagaaatattatgaggtggatattgttttaataagggaataagattcttatctattaaagaggcatttgtcattaaatcaatcataaatcctttcctttttgcataaacataaatttctgaaaagaaatcataggtaagtatttctccaccagtaaaaattaatagaaaacatcctgattcatataatttatcgattatttttcgtacatcttcataaggtatatagggatttcttttgtctgaacaatagcaatgaagacaattgaagttgcatttttgtgttaattcgatacttgcaaaaaaaagcaaatcgttatttatataccatttttttatctgctcaaaattcatttactttacctctaaatagcctttgtcaattaaggttttaatcatagtttcaaaatcttttgtttttataattttctcgtccaatcctgttttcatttgatcttgtaaatagagaattgccggtttagatgcactcaatatttcgtttgtatgtatattaattagaaatgcacgatttaaacaaaatcttattgcaatgtctgaattccatgttatcatctttatctcctaaagggtgagttttaagtaaattcgtctcagtcgaagttttaatttctggctgagacgaatgctttgtgaagaagcgcagtaattctaaagaacatttatcgtcgtattgttgaatagaattatgcgccaaattatgattgtttgatttagagattaattagcagtaaacaccacttccagtatctccccaacaaccagcttgaacttctgtgttatcacgaagttcagtttctgtactgattacctcaagagtaaaatcaatattgttttccattctattgcctccttcctatgatagaatatttataatgaaattatttcattatcatttatagttgtattattaaaaaagaaatttgtattttgaagaatattcagtcgtaatatttatcatttgaatcatcatcttcatcaaaataattgtcctctccatattcttcaatgcatcgcatatcgttgtattcttctaatcctatactgctttcatcatcatcacggttaagccattcgtcgtagaattcatattcgtctcttggatccataaatttatacctctcttaaataattctctagttcgtgtaaccaacatgatgtgttatagtcacaataagcacgttgggaatggtacatatcaatgcacaatttcatggaagttacacttggtagtctaccagttctcaattcattgacgtattcttgtggaatacgaggataccatacctttcggaaacccacacagccgattttattggcaaaatggtttgaatcttgaggatcttcagagtataatgtaattggggaatatagtcgatccagatagtcaggatttgaaccttgtgtttgtcttgcaatatttgcatataagcttgatacaatgatgatatcgtaattgtaaggttctgatgcaaattcaagttgtgcacctacagcctcaggcagaaaaatattcatttcggatgagcttgtaggaattagttggctttttacagacaaaggacgcatttgccttaaaatttcatctggttttgcttcaggatttgtaagaaaatattgtcctttgcgattaacggcaaaattatcagaatttaggtagagaaaaagatcatgatttacaccgttatatttacggggtgtgtgtttgttcatttgagaattcctccaatcatttgtttgataagaggatgatagcatgtttgcaatgggaatgctatgtgtatttatgtgtatttgataagaggagaaaaatataaaatgaaaacagagctatggtatgagcgtgaatttggtccggaaaaagagcttagactttttttttctaaattattaagagagtgtttgggtatgaaaaatggttctggcgttgttaagggtattgaagaatataaagctggacggcctttttcaaatgttttcaatagaactaaaaaaggaaattatgtttttacacctacaatttgttgtgattttttggaattgacattaagaaacgagtcttttgatagagccgtgaaagtaatacaagagtggggaaatggtttagatgagtgtaatttggataaattgaaacagtgccctaatatagaaaaaaatgaaactgagatggggatttattgcaaatgcattgcagctatttatgatggaaaggattttaaagataaatgcaaagattgcccaataaaactaatatatgaaattttaccagatattgaaaacgaatatcgaactaattatgtttgtaaaaagaaaatattggaaaggtatgattcatctgttcaagaagaaagcgttagtaaaatatataatgatatacaagaatttgaaagagagtttggaaataaagaatttaatataaatgaagtttgtgaattgtttgaaaaatgtatccagtgtatggagatagaagatgtgcgtgattataaattagcatatataaaatggtacactgcaagattatgtacatggccttactttaaattatgtttattacaagccaatagatatgatgaaagggttgtttattcacttttgcaatctgcttcagttatatgtaattcaatgcagattatagaagatgagtttcaattatgttataatattgaaatggataagattatatcatatttatctcttgcatatcaaaatccatttatagtgaaatattgtgaaaaatcagaagaaattttgaacaattgtagtagacttgtaaaaatatgtccagaaagccaatatcaattagaactttatacagaaatgtggaatttagcatctcatacacagcaaaatttagataatatatataagaagaaggtacaatatttactaaaagaaaagaatttagatagggaaggtgagagatattatacttattcctatatgtataatttatgtaagtgtgaaaaaccaaaactaatattatcggcaaaggcgtatagattaagaaaagagaatttgtataatgatacaattgctatgataacggaattatttttaagtaaagctttagatgatagcgaatttgctgaatctggaaatctaactttggacattataaggataaaaggatatgatgagaataaaaaaaatagggttacagaggagtattcagttaccccaccatctgcttatcaaagaatttatggagataatatgctgattagtcgggcatctacttatcaaagaattcatgaaaatgctaggataataaaatctatagatgattatatggagcgtataaagcaggaacaggcaaacgcagatgaaaagtgagatttttaaccagaaaattcgatgaaattttgactcttgcatcgtaaaatagaacaagtaaaagaaaataaacaggcatatcagacatggggaatgatatgcctgtagtgcgttgtttgagtttacatttacttgaacgaaggattgatgtaggaagaaggtacgattgaaatgggattaacaaactatgtaagtgcaatggattgctggaagggacgtattgacagtacaacagattatgatgcatttcgctggcatcagtgggtacagccgttggatttgaatatacagacggaaaagccggagtgtggactgggttttgcttttatcggtttttgcagtgagcagggagtaaagcgtaacaaaggtcgtgtcggaactgcgcttgcaccggattttatccgtgcacagatgtcaaatcttccatgtacttttttacaggatgtcaaattatatgatgcaggaaatattttatgtgatgagatctcaatggaagaaggacagaaactgcttggcatggcagtggagaaaattttggatttagagctgtttccgattgtgcttggaggcggtcacgaaacaacttttggtcattttcaggggcatctggcagatatgaagaagaaagaaaagcctcttgatatgggaatcattaattttgatgcgcattttgatttaagaccttatgaaaatggtccgtcatccggttcgatgttccgccagattgcagatatttacaaaaaggaaaatgtgcagtatcattatcttccgttggggatacaggaacatagtaatactgtcagtttatttaaatttgcaaaagaaatcggaacagaatatattcttgcaaaggaaatccaaaattccaattatgcaacgatattagataaagtggatacctttttatatcagtgcagttcagcatatattactgtatgtaccgatgtattttcttccgcttttgcaccaggagtcagtgcaacacagtcactgggactggaccctgaagtggtacttccgattatcaaacatattttgagaacccgcagagtcagaggatttgatatctgtgaaatctctccgagatttgaccaggataatacgactgcaaatcttggtgcagtgattatatttgcggtggtaaatacgctttgtaaattaaataatctggcgattgatgtattggaataagggaaaattattaagaaagcaagagggaaaagacaatgtattatgtgccagatggaacaaaagaatgtggattttatgaatgtaaaaaatgtggaaatcgttttctttctcttcaaacgatggaaaagattccgtgtccggaatgtgaggcagaaatcgactatgaaatcggaccagatgaaagcttggaagatgttttagacactgccgtcttactggaaaaaattgaaggattagaagaagtagaaaaaatggatgcacttttaagtcttgcaattaccggaggggatgatagttggatttaagagttcgcatctgtaaattcttaaaaaaagaagtagtgctttgtgttgcttttgtgctggctgtaatttcttcttttttgattcatccggacaagaaatatatacagtatattgattttcggaccttagcaattttgttttctcttatgagtgttatggcaggattaaagttgcatggagcctttgattttgtggggcgtaagatgctggaaaaaacaaaatatctttggcaggtcattttaactttagtgcttcttactttttttggaagcatgctgattacaaatgatgtggcgttgattacctttgtaccatttacttttgtggtgtttaatttgctgggagaatcctaccgaaaaaaacaagttttatgggtagtctgtgttcagacgatcgcagcaaatcttggaagtatgctgactccccttggaaacccgcagaatctttacttatatggaaaaagcgggttgtcatttggaaggtttcttctattaatgctgccttataccttaactgcgctggcgcttctttgtagttggagttttttgctttgtgtgaaagaaaagaaaaaagtaattcaaatggagtggaagtcagaagagcaagtattttgtaactggaagaaaataagagtttatctgatattatttggaatctgtctgcttgcagtcctacatatcatggattatcgaatttcttttttgattgtgttgcttcttatctttctatgggacagaaaaagtttgaaacgagtagattattcgttattacttacgtttgttgcattttttatctttattggaaatgcaggaagaatttctgctttttcattatggctaaatcagattatagaaggacgggaggtaattgtggcagtgcttgcaagtcagattatcagcaatgttccgactgcacttttattatccggatttaccaataaaatttcccttctgattatcggaacgaatttgggtggccttggtacattaattgcatcaatggccagtttgatttcttatcgtcagattgcacaggaagaaacagaacgaaaaggaaagtattttttgatttttacaatctcaaatgttattttcttgttgatttttcttggagtatggaagatgacaggggtacagtagaaaatctgtatggaagaaggaagtgtaaaagctatgagaaaacatgcgttaattgtcggaccacgcagagttggaaaaagtacgttaattcgtaaagtaatagaaactttgaattattcggtagcaggttttgagacaaaaaaagaatcaaaaatggaggatgaaacgctgggttctcccatttatattcatacgataggagcaccgtggcattattccgaagaaaatctgttgggatattgcaaaaaccagaaaacacaaagaatcagcgatgcatttaatcgttatgcagacaagctgttacagccagtacccgagggaacgattctttgctttgatgagattggattcatggagtcaaaagaaaaggcattttgtgatgcagttttagaacgacttgacggagacattccgattcttgcagcagtaaaagataaagaaatcccttttttaaatcaagtgcgaaatcatccaaactgcaaatgcttttttattacagaagaaaacagagacaagttagtggatgaagtgcttgaatttatgaaaaatcaaatagaaaaataaatattcagaaaatggatagaaatttggcagagacaggctggatttttatccatttttgatttacaggaaattgctttctcataaaaatgattgaaaaagggctgcttattattgaggttctttttgttttttataataaaaaaataaataggtacgacaaaatatgacgtcctccattgctatgataatagcgatggaggagtagaaaaatggcgagaacagataaggctatgcgaatactttctacgcagttggaattgctgagaggagggaaagtttataaaaaatcttattgcaagaagaatgaagtcagtgcccgaacatttgacagagacattgttgaaatccgtatgtcattaagtgaatcattttccgggcaggaagtgaaatatgtaagaaatgaaaattattattatctggataaaccggatatgataaaaccgttgactgcaattgaagcatcttttttgttggaaatgataaaaacatgtcaggtacttcaaagggaagaatatgtgggaatggtagacagtattgtgaaggcaacggaattgaaccgccgtcagtcacttgaaaaaatggcagagaaatataaaaaaatggatataggggtaagcgaagatgcaatgctgaaaatgctgtgggatttattgcagtgtgttgtagaacaggataaaatcagggttcattttaaggataaaagaaaaatagaattatcaccggtctttttgtggatgtatcaagataaaatttacctgtttgcttatgagaaaaaaacattaaatgtatattctctgcatgagattgactggtttacactgcttggaagcaagtatccgagagaactgcaggagaaattttataaagtttcctgtgaacagatacataaaaggataaaaaatatagaagaattaaaagaagaggagtaagcatatcgacaggttttttttaataatgtaaaggagaatttgaatgaatgggacaaaatctgcaaaagaatatcgaaaaggagaacaattagaaattacagaagagaaaatgacagaagaaacactggaaaaaatagaagagatttttcaggaatttctcgaagggagaaatgaaaattcaaaaaagattgcagattctgtagaactttatgaaaaagaattagaagattttaatcgaagcatgagagcaggaatcacaaaagaatcgtggtttctggaaaaattacaggataaagcgaaaggactttccattgattattttggaaatattcttttggagatgaatcaaaaactggctgaatcaaacagaacaatgagcaaactgctgtttgaaacagaagaaatagatagaactaatattgagcagaagaaaaccgtaagaaaatgcaaaacaaagtggaatagttataatacgaaagaagttgcgctggaattagcaagagaagccagatgtcagcttatgttttggaatcaaaaggatgagtggctgaaaaattcacagtttttagaaaacctggcaaaaagctggtttgaacaggagataaatacaaataaaaatagtgaattaaaaaacgtcattgcagaagcattaaagaccgcagggaaagaacagcttcttccatatcaattttcacagctttcaacagagtggcttaccagaatagcctgcgtatcggtagaacatttaaaaattatatgggaaactgcaaaaggagagatggcaatgcgggaagcaacagaagaaatcgaaaagtgtattcttgtgttatattcttcttttgatttgaaaaatgtagactttctctgcttttatgcccctttgttagggagagtgacagaggatgtccttaatagaacgacagataaagaaaataaaaagaaaaaagagaaaaaatagccgaaaatgcagggcggaatattgtgaaaaagagcaaaaaaggtatactaagagatagcaagaggagtggcttttcttagaaaattataaaaggaaaaaatttttaaacaataaaaaggatggacggaatgtgtctatatcaaatgctatgattcaatcaaacgatggaggaaagccatatatgaaagaaaagaacgaaagtaaagagaaaaacaaaaccagaaacgaagataagaatgaaggtaaaattatcagagttttagaaatctataccagactgttaaacggagcggttatcaacaaagaagaagaggcagagcggtatagagtggcaaagcgaagcattcaaagagacattgattcaattcgggaatatttaagacgaaccgataataaaagcggagtatatgatttagttaactatgattacagaaaaaaagggtactgtctggaacatatttacaaagtaaaattaaaaagcagtgaaatacttgcaatctgtaaaatccttttagaaagccgttcgatgacaaaaagagagatgacagatattctggataaattaatcgaatgttgcgttccacttgagaatcaaagagtaattaaaaatttaattttaaatgaagaatttcattacatagagccacagcataaaacagtatttatcgataaaatgtggaatatcgggcaggcaattcgagaacatcagtacatagaaatcgaatacaaaaagatgaaaggaaaagaaacagtagcaagaaaactcaaaccggttgcgattatgttttcggagtattatttttatctgacggcatttattgatgataaaaaggtgcgggaagattttaatatcttagaggattcttttccaacgatttatcgaatggatcgaatccattctttgaaaatttcaaaagaaaaattcaatattccatacaaagaccgatttgaagaaggagaatttcggaaacggattcagtttatgtatggcggaccactgcagaaagtacgctttaaatacagtggaatttccgttgaagcagtgcttgaccgcctgccgactgcaaggattctgcatgaggatgaaagcggatatacgattgaggcagaagtgtttggagaggggattaagatgtggatacggagccagggagagttgataagtgaggtgagttatcggtaggagatgtagagtagttcggcagaattgattttctgttagaggaaaattgggaataagaaaaagattgaaattaaaaagcatctcaaatattagatactgtaccgcccccaaaaagttagactaaaaatttgacttttggagggcggtatttttattttggataattttcataagcggaacgaatgatttgaataattttttcaacaacggtttgtggtgaaattacttttacataatgccctagaaagagaatattgcgaaaaatttcttcttcttgaaaatgataatagtagatagtcatagtgagtttattattttgttcataacaataagtgtcataagaagaaaaaagataagtacaccggtcataagcttctctctggtttaaaatttctaactgaattggatgtgttaatttaatattagaaagttgtttttcaaaatctataataaattcatcataattcggaatgacagttccaattgaaacagaagatagatttgagagaattattttaacggggcgtttggcactaattggatagcatgagaggcaaaataaattaaattgtggtgaatattcaattttatagggatatacaatttcgttagagtaaattttaccggattcactgtgattggtaacagtgagctgccgatgctgttggactgcctggacaattgtttgaaaatgggtaataaattgtggagtaatatccaggcagctttctgtagaaaactctcgtatatctatataatgttgctggaggggataatctttaaaacttatatctttcaataaggcatcaagaagtttttgctttaactctgaatttaaaaataaatcggagttactggtttgaagtacatagtaaagccaggctttttctgcaatgcttgcccgaactggaataggaacttctctaatgggttgcagcttgttctggtcatctttatatagaagtcctgcattatgatttggaaaaacagattgatttaaaactgcatgaataaattcttcaaaggtgctttgagaagttcctaataattgatattccagttcctctggagtcagtgccagttcttcattagagatacagctgttaatgtaatttgtgagatacataaaatttttattcttatatttattaaatagtttcatattgttttaaagcctctttccagtcgaattttaatttttgtgcgagaaaaggattcgtttcggaatcaactactgcataagcaccgaagcttcgtatccagggaattaactcgcattcatcttgaacttcgacagtaaaatcaatttgtccgttctcaagtttcgttattgtcccatgacgtttggttgaaattaaatagttcgaccattttttatagttttctgttggaaaagaaaaatgtatcgttacaatagaggttgtatcatttagtgcaacattccagatattttttgtctgttccttataagtctgagtatacaagctgtctaaagtatcaggagtttcatctgattgttctaattcaaaacattcatattttctagtcacattaaattttttatcaatttgaatatcaataatagatgaaattttggccataaaaaaatttttttcatcataactgtaaccaaaaaagtactgacgcccgtattgcttatcaattaccagttttattggaagcgaatgaaataatagttcttcggagtcttgagttttataagaatattgtagtacttcttttttgtgtatcgcagttaaaatcgtccaggttacatcatcatcaattacggtttgcaggcgatgatttttataaaagaagaccggatttttttgtttgtaaaaaaaattcactttttctttaagaaaaatagaatttgaataggcttcaagtgtagatgaaagataaaaaccgggtatcgttaaaaaagtactattataaaaaaactgagtcattaactgaaggtcgtaaagttcatctgcggtcaggtttaaaaagatatcagaagataaatgatatctgatttctttagaagaatttgtttttataagaataccaatgtcagtaagttcggtcaaacgtgcacggatttgtggaggcgtaaataacttgtcattgtatttaaaatcaggaagcagttggtttgatttttttaaaatcgttaaattagagttataaatattagagataattgtaaataagtcagcaacagaaatattaccattaaattcaacggaatcaattttatcagcaggaagtttataatcaaaatgttcgtaaggattcttatcatctgcatcaataaaggtctgcataagacagaaatagaaaataatatcatcaataacataagagcaattttgataagtttcagcaagataatttacaggacagcgaaatgggtcatagattagatgaaattttttaccagaagccgtttcgataacttttggttcttgtaagtattcactattaatatagtttttaatccgtagacaggtatgataaaaagaactggtgctattaatcagttttttttccaaaaactcatctaaagacgaaatatcatataaatataagtaccgaagaatattacggattttattataatgtttgatttcattttgaaaagtatgagtgttttttgccataagttcctcccagggtattgtaggtttttttgaacgaagaaaaatatcgttgtgataagataaaattatcaaataacaaagaaaatttacttgcgaatatatctataaaaaatatatcaaaaacattttaacaaatccagagagaattattaagaggaggaacgttaaatggaaaaagagataagagataaagagaaagtagaaagagttttaggaatttatacaaaactgctggatggaataactgtaaataagcagaaagaagcagaaaagtatggggtagtaaacaggagtattcaaagagatatagataatatacgcagttatctggcaaaaacagataatgaggaaagtgtttataataatgttttatatgattataaaagaaaaggttattatttagagcatatttatgataaaaaattaaatagtaaagaaatgtttgtgatctgtaaaattctgttagcaagccgttgtttaacccaaaaagagatgtccgagattttaagcaagctgataaaaacttgtattccattagaggaccaaaaattaattacagaattaatttctaatgaggaatttcattatgtagaaccacgacataaagtcatttttgttgataatatgtgggaaattggacaagcaattcatgaccagcattatatagaaattgagtatgagaaaacgaagaatgaaaaaacgataatacgaaaggtgaaaccggcggctattttattttctgaatattatttttatatgatttcatttgcaactccagagctggaaagagagaaatttaaacgtgttgaggattctcttttagtaatttaccgtttggataaaataaaaaatttgaaagtattagaggaaagatttcaggttccttatgcagaacgatttgaagaaggagaatttcgtaagagagttcaatttatgcaaaatggtccacttcagaaagtaagatttaaatacaatggcaaatctgttgaagaagtattggatcggattccaacagccagagtcttacaggaaaatgaagatggggcgataattgaggcagaagtgtttggagatggaattaaaatgtggatacgaagtcagggagagttaataagtgaggtgagttataggtagtaaaaataatatgtaaaaaagattagcagatgaaaacctggtaatcttttttaacactcttgacaaattctattagttagaataaactatctttaggtagaagaggaaacaggaggaacacgcggatgtctttggatgtacttgcattggaatttaccgatatgcagctcaagtattcaaaagaaatttcagcgtttttggatagggcatcagcgtttggacaagaccggattctgatttatctatataaagaaaatgaccatattctggttggagatttgacaaatgaactgcagatgtcgaccggaagaattgcaaatattttaaaagagctggaacgaaaagggtatattctaagaattcagcaaagggaagataagagaaagtatgaagtttgccttacaaaaagtggcgaaaattacagcagggaattgtatgcggatatggttgcgaatcatagagcattgatggaacagctgggtgagacagatggagagcagctccttaagctttctgagaaagtattgcggtttagaaaaacaatggtttgtaaataaaacaggctgaaaaagcctgttaaaaaatccaaaatatcttctactgaaagataaactataaagtaaagaaataaaagaacaaaaaacataagagaagggagattagaaaatgacgctcaaagaacttgaaatcggcgagagtgctgccatcaaaaccgttggtggttcaggggcacttcgtcagcattttcttgacatgggaatgattccgggggcagaagtcacagttgtaaaacttgcaccaatgggcgacccgatggaacttcagattcatggatatgaactgacacttcgtctggcggaggcagaccagattgagattgagccgattaaaaagagaagccgtgcacacgaaggaaaagagtatttaaaaccatctgaacatccggggcttggtgaagatggaaagtatcattctaaagaaagtgaaaatcctcttccggaaggaactacattgacctatgcattagtaggaaatcagaactgtggaaaaacaactttatttaatcagttgaccggttcgaatcagcatgttggaaatttcccgggagttacggttgatagaaaagatggttcaattaaggggtattccaatacagatgtgacagatcttcctggaatttactcgatgtctccatatagcagtgaggaaattgtttcacgaaattttgtattaaatgaaaagccgaaagcaattattaacattgtggatgcgacaaatatccatagaaatctgtatttaacgatgcagttacttgagatggatgtgccgatggtcgttgccttaaatatgatggatgaagttcttggaaatcagggttccattgatgtaaatgaaatggaagctctgcttggagttccggtcattccgatttcggcagcaaaaaatgaaggggtcagtgaattagtcgaacatgcgattcatattgcaaagtatcaggaacgtccgcttcgtcaggatttttgtgataaaaatgaccatgatggtgcagtgcaccgttgtattcatgcggtgattcatttaattgaggaccatgcacaaaaagccgaaattccagtacgatttgctgcaacaaaagcaatcgaaggtgacaatctgattctggaacagctgaaattagatgaaaatgaaatggaaatgctcgaacatattgtacagcagatggagaccgagcgaggactcgatcgaagtgcggcaattgcagatatgcggtttgattttattgaacggctgtgtgagaagacagttgtaaaaccaaaagagagcaaagaacgtattcgaagtgaaaagattgataaaattctaaccggaaaatatactgcaattccatgctttatcggaattatggtattagtcttctatctgacctttaatgtaatcggagcatggcttcagggcattttggaatttggcattgataagatttcagaagcagtgggctcagcaatgactgcggcgcatgtaaacagtgcagtgcatagccttgtaatagatggcatttttaacggtgttggaagtgtattaagtttccttccgattattgtaactttatttttctttttatctttgatggaggacagcggatacattgcacgtgttgcttttgttatggataagttgttaaggaaaatcggtctttccggacgaagtatcgtgccaatgctgattggtttcggatgtaccgttccggcagttatggcaacgagaacattgacaagtgaacgtgaccgtaaaatgacgattcttttaacaccatttatgagctgtacggcaaaacttccgatttatgcattttttgtaagtgtatttttcccaaaacagggcggactcattatggcaggtttatacttgcttggcattttggttggaattctggctgcctgtctttataaaaatacgttatttaaaggcgaaccggtaccgtttgtaatggagcttccaaactatcgtctgccgggagcaaagaatgtaggacagcttttatgggaaaaagcgaaagatttcttacaaagagcattttcggttattctgcttgcaacaattgtagtttggttcttgcagagtttcgatttacatttaaatatggtaaaagattccgcagacagtatacttgctatagcagcaggatttttggttccgattttcaaaccggttggtcttggagactggaaaatctgtactgcattaatcagtggatttatggcaaaagaaagtgtggtatcaaccttagaagtgctctttgtaggcggaatcgcaggtgtgctttctccactttccgcagcgtctcttctggtatttagtctgctgtatacgccatgtgtagcggcaatcgcatctattcgtcgtgaacttggtggaaaatgggcggttggagttgtattctggcaatgtgcagtggcatggatttgtgccctgattatgcatttaattggacttggaattggattttaataagtaaaaataaaagatgaaatgctttaaatgtcggggcggaacgcctcggcattttattgtttatttttattgacttttgtaacgtaagtagttaatatcaagttatagagtaaccggttactttgaacgcagataagcattcccccgcttcaagtgcgcggagcactaagcggcgggtgagagggatgcttatgtcaatgggagttgaaagctcccgctgacagatcgcaaagcgactgcgttcatgagaaagtagcgaagcggattgcgaatgtccgctttactgaaaaaagtgacaaaaataacaaaaaaaataagaagagatagtagaaaggaaaaaatttatgaaacaggacgtattacatttaaaatccccagtcaactggataaatgacccgaatggttttatttattacaaaggaaagtatcatttattttaccagcattttccttatgctccaatatggggaacaatgcactggggtcatgcggtaagtgaagatttagtgcattgggaacataagaaaattgcattatttccgacaaaatcttatgacagaaatggtgttttttctggaagtgcaattgaaaaagatgagaaactttatttctattattcagcagtacgctatctggaacaggatgaagaaaatattcatctttctaaaaatgaccagattgagacaagtcaggcgatgctgatttcagaagatggagaaaagtttgataattggaacggaaaaaaacagattattccggtcattcgggatgaagaaattgcagatgccagagatactagagacccgaaggtctggaaagaggatgaaaagtattatatggtacttggaagcacctatcatggaaagcaggcaagagttttgatttttgaaagtgaagatggagaaaactggaattataaatctcagtgtcggaaagagacttatggtcatacgatggagtgtccggatttatttaaaattcgtgagcagtatgtttttgtcggttctccaatgggaattcaaaatgatggtttggaatatgcgaatcagtctgtctgtacattggcaaaatttgatgtcaaaaccgggaagttaagtttaccggatgagtatcagatggtggactatggcggtgatttttatgcgccacagagcaatctggataaagatggaagaagagtgatgattgcatggatgcgtatgccaaaaccggtagaatcaaaagatggaacacagtggatcggaatgatgtgccttccacgagtggttggaatcaaaaatggacaggttacatttgatgtgcatccgaatgtaaaagaaaactttgaagaaatagatttaactaaagtggtattaaaattaaaagaaaaacagccactttggataacaacgactttatcagaaggagaagaattagaaatcggtggatacgaaattcgtctggaggatggagcagttgtaggaaatcgtgaacgtgtatttgcagatatggaaggatatcatgtggaaaatcagaccccgaaagtagggaaatctgcaaaactggatatttttgtggaagaaaatttaattgaaatttttgtcaatgatggacagtatgtcttaagtcatgtggtttatggattaggagatacactgaatggaaagattcagaaggttcgagtattgaaataaattatgacaccgccagatattttcatgtatctggcggtatttgcttatgctgctccatataaaatgactccttctctatgaatattagaataaaatggataatttacaatccaattgttaaaatgagcttcacttttagcaattggttttatatcaatattataatccatattaaaatcatacatcatataggagagtttttgactgtatgctttaagttccaaatctgataaatctaataaaatcataatatcaatatctgagtcaggtctaaaatcacctctggcgtaaatgtgtgccgtatatctgctttatttcatttacatattgtttaattaaattttgcatatttcctggcatatacatttcccctttagatttaaattgatataatataggttacgtttttattatacccagattttctttttttttccagattttatttgtaaagaaattttcatttgcattacttaagaaataagatatactagaattattaaaagcaaaagggggtttttagatgattttggtaggtattatgctggttacggaccttatcatggttgcaattgtggcagcagtttatggtggaaaaacaaagtatcaaagcggaatgatacttggaatacatcttccaaaagaagtaatttctcaactagaagttgtagaactgactcagaaatataaaagaaacagcagatacttttatattttaaatttaatgcttggctgtgtggtctgccctcttggtttttggtatacctcaattttgatgattgtctggagtatctggttttttgagtttatttttggttctatgaaaatcctgtattcggcgcatagaaaattatatgagataaaaataaaaaatggctggggtcaaaatccggcaggtttagcagaggcttctgtgccagatgaagattattattggagaaaaggctggtatgagaatccggaagatccccatttctgggtgcaggatcgctattccagtactaattacagtcttaatatcggaagaaaaggtggaaaaattttcctggcagtgattacaattggaacgttgtcattatttatctggatgtgcgtgatgtttgtgaggatggattttactccggtgcgtctaaaaatagatgccgaacatgtaaaaattacttcaggatatacaggggcagaatttgataaagatgaaatagaagagataaaattgattgaaaaactaccggatgaaaaatttgtccgcacaaatggctcggcagatggaaatcagtggcttggaaaattccgtggaagcaagagcggagcgtgccggatgtatgtctggttaaaagaaacgccaattatcgaaattaagacagataaatatacgatttttattaacagtaaagaagatggtcagacggagaagtggtatgaaaagttaaattaaaaaagcggagagtcataaaatgtagtttacttatacacaagaaaagaaatttacaaaacagcaggtacatgaaaaaatattgactctacaatagatgtagggtttaatgttttttgtgaaaggagttgtcagttatggaaaacaatttaacttccggcaactctgtttccgatgggacttgcaacagcctttggttttttaggctctgtttttatctgcattggagcatttttgtggtttaagaaaacaaaacgactggtggcagtacaaaatggataacaagaaactctttcggattggtgaaatggcaaaactttttcacttaagcgtgcagactctgcgtcattgtcaactacccaccacctaaaggtagtgggcttgtaactgcccagtcgtaatgaatatttgaacaaaaaaaccactgcaacacagttttgaactgttcagcagtggcttttttgaatttgttgttatgcaatagatttaagcaatagatttaaaaaggacggttttatatttataaagtgcttcgtataaaatcagtccaatcacacctgcggaaatgacttcgccaactccgactgtcagcatcataaatggaatcggaagtggtacggcataagcatattttaatacgaatggtacgatgatggtatttgcaacaactggtggaagcggagcaagatatttgcttttatttctaagcatgcgtgtaaaaacggctccgattaaagttgcaatgcttccaaagataatatccggaagaatcgcaccgcctaaaatatttccgagaaggcatccgataaataaacctggaattgccgccggagtaaagaccggaaggatagtgagggcttctgcaaaacgaatctgtacttcgccaaatgcgagagaagcaccaaggacagtcagtacaacatagatagctgcaatcatggcagcctgtgctaagaaaagcacttttgagttttgatttttcataatatttttctcctgtagttttgttttacgtgtggaaggtcacgaacacacgattactaaaacccgaaagaccttggttaacaggggtttcagcggttgttagtatagcatgagaaaataaaaaaatcaaggaaagtaccaaaaaagtaccaaataggaaaagtggctggaaacttgcttaatttggttaaaaatttaaagatgtgcaatgcaaatataatgcattgacaaaaatattgcaaaagtataatctgatggtagaaaagggtgttaatatagcaacaacgaattttacaatgagaattgacgaggctgttaaagctcagcttcagcaattaatgaaagataagagatagaaagagcaggattaaaaatgaaagtgagggttttcatatgaaaaattattcagaggacgcaagcaaacagtatcatattcaggtaggagaaggcgaagttggacgttacgtgattctaccgggtgacccaaagcgctgtaaaaaaattgcacagtattttgaaaatccggttcttgtagctgacaacagagagtatgtaacttataccggaacattagatggagtaaaagtaagtgtaacttccactggtatcggtggaccgtcagcctctatcgcaatggaagaattataccgctgtggagcagatacctttgtccgaatcggaacttgtggaggaatgcagacagaagtaaagagcggtgatattgttattgcaactggtgcaatccgtatggaaggaacaagcaaagaatatgctccaatcgaatttccggcagtcgcagatttaactgttatcaacgcattggtagaaggagcaaaaaaagaaggctgtgaattccatacaggtgtggtacagtgtaaggacgcattttacggacagcatgagccggagacgaaaccggtcagctatgaactgatgaataaatgggaagcatggaaacgtttaggatgtctggcttctgagatggaatctgcagcactttttgtagttgcaagttacttaaaagttcgagtgggctcttgcttcttagttatagcaaatcaggaaagagaaaaattaggattggacaatccggtggtacatgataccgataaagcaattcaggtggcagtacaggcaatacgtgaattgattcgtgcagataaagagaatcagtaagattaactgttaaggcatcaaagacgcagaaaaatttcttgcacttggagcagaccgtcttggagtaagccggattgtaaaaacggtgaaaaaagaagaagcaacaggatattgatattaaagaaaaaaacaatagttgagctgtaaaacgaaaggcaggaaaaaatcatggacaaaaaacagattgaagaaatgattgatttggcagtcaggcagttagattactcctatgcgccatactcaaactttcatgtaggagcggcacttctggcaaaaaacggaacttattacacaggatgtaacatcgaaaatgccggttacaccgcaacaaactgtgcagagcgcactgccttttttaaagcagtcagtgaaggagtaaaggaatttcaggcaatctgtatcgtaggtggaaaagatggggtgatcactgaatatgcagcaccgtgtggtgtgtgcagacaggttatgatggagttttgcaaccctgaaacatttcagattattctggcagtcagcaaggacaaatatgatgtctttacgttaaaagaacttcttccgctgggatttggaccggccaatctggcataacaaatagtaaaaaattatatggtatattaacatggttttgtgtcggagcagacagaaaggaattgttatggaaacttataagagagtatttgtgattgttttggattcacttggaattggtgcaatgccggattctgaaaaatttggagataaaggtgtagataccttcggacatatcttagataagatgggaacattgaagattccaaatcttcagaaactgggaatgttaaacctgcataaaggcggaaacatggaaggtgtcgaaaaaccaatcggacgttatatgcggattggcgaagccagcaacggaaaagatacaatgaccggacactgggaaatgatgggaatttatactccgaaaccgtttaaaacctttacggaaacaggatttccaaaggaattaatcgatgaactcgaaaaaagatgccacaagcgtgtcatcggaaataagagtgcaagtggaacggaaatcatcgaggaacttggagaagaagaaatcaatacaggagcaatgattgtatatacttcggcagactctgtcttgcagatttgcggaaatgaagaaacttttgatttacagaatttatatcattgctgtgaaattgccagggagttgaccttaaaggatgagtggagagtcggaagagtcattgccagaccttatgtcggaaagaaaaaaggcgaatttaaacgaaccagtaatcgtcatgattatgctttaaagccaacaggaaaaaccgcattaaatgctttaaaagatgcaggatttgacgttatcggtgtcggaaaaatcaatgatatcttctgtggagaaggcattacaaaaagctatcattctgaaagttcggtacatggcatgcagcagacagtggaaatctgtaaagaagagtttcatggactttgttttgtaaatttagtagactttgacgcattgtgggggcataggagaaatccggaaggatacggacatgaaattgaaaagtttgacgaaggacttggaaatttattaaacgaaatgaaagaggatgacctgttgattctgaccgcagaccacggaaatgatccaacatacacgggaacagaccatacgagagagtatgtgccgtttgttgcttattctaagaaaatggaagagggcggagcaatcgaaaatcaggatacttttgcggtgatcggagcttctgttgcagaaaactttggagtgaaaatgccggaagacacgattggaacttctattttaaaccagttgaacgcagataagcattcccccgcttcaagtgcgcagagcactaagcggcgggtgaggggggatgcttctgtcagtgagagttgaaagctcccactgacagattgcgaagcgactgcgttcatgagcaagtagcaaagcggattgcgaatgtccgctttacgtaaaagagataccggcggaaaaaatataaaaaggaagagacaggctgattgatatcagtaggtctcttcctttttgcagaggtttgtatgtattaatttttatagagggaacagtaactataactgtttattttttgatgatttctttcattacttcgtaagtacctttggtacggatttcttcaagacaagtggtaactgcatgttcaaatccatcgattgtgcttagatcttcaccccagaatgaggtatttgtgcagactgcatgaaccaggtcttttgcactgtcatctttgtgtgaatagaaaaattctaagacatcagtatcgtcttttacggtgtaagtaccgtttttgcgggatgcattcagtccgtcagcagttaattcctgaccattgtagaacgcaatatagaaagcgaaagatgcagtgatgcatgctggaaggcttcctcttcttgcaacatattcttttaaagaaggcataacacgtgctctccattttgaagtagagtttaatgaaattgcaagcagcgcatggtcgataaatggatttttgaaacgttcggtaacggcagatgcaaagtcttctaattcttcttttgaaaggtcaagagtcggaatgatttcgtcatagatggtctgattcataaagctgcaaatcacttcatcttccatacagtttcttacgatatcttgtcctgcgaggtatgcaccaagcacgaaagaagtatgagcaccgtttaagatgcggactttgcgctgtttgtaaggtttgtgattgtctgtaacaagaaccggaagtcctgctgatttagcaggaaattctttttctaaagtttttggtccttcgattacccagaagccgaaaatttcaccggtcgttaaaatggcatcttcataaccgttttcagcagttaaagtttctgcttcggcagatggatatccagttacgatacggtctactaaagtagaacagaaaaggttttcagcctcaatccagttgatgaactcttctccgagttcccactgttttgcatagtttaagacgcattttttgagtgcttttccgttatcttcaattaattcgcaggaaagaataatcagaccttttctggattcttttccgaatttttggaaacgacggtataaaacctgagtcagttttccagggtagctggaagccggagcgtccgtaaactgacaggaagcatcataaacgatacctgcttctgttgtattagaaaccacgaaacgtaacgcttcattgtccgcacaggcaagcagtgcttcaaaatcgtcataagggttgatgcatcggctgacacaggaaaggatacgcttgttgtttactttctgtccatcttgaaatcctcttaaatataaagtataaagcccttcctgttcattgatagcggcagctactttagaatgggatgcagttggtttgcagatgacaacttttgagttaaaacccgctttttcgttcatcacatcaataaatgcatctgtaaaggcacgtaaaaagttaccctctccaaactgaagaacacgttcaggggcatcttctaagagatacccgtcataattcatttcatgaagggtttcataggataattttttcatctttttcttctcttttcttctgattattttatttaagttcggaaactataaattaaagggtgacgccctgcttgaagattgccatgtcatggaatccggcttcttcagatttggatttctttccggatgcgatttcaattacaaaatcaaagagtttagaagaaagagagtctaaggtttccccttctactaaagtcccacagttgaaatcaatccagttattttttttatttgcaagtgtagagttagttgcaatctttacagttggaaccggacttgcaaatggagtgccacgtcctgtggtaaataaaacgatgtgtgcaccggaggctgcaagagcagtggaggcgactaaatcatttccgggagcacttaaaagatttaagccgtgtgtacagactctgtctccataagaaagaacaccttttataggagcacttccggatttctgggtacatccaagagatttatcttccagagtggaaattcccccttttttatttcccggagatgggttttcgtaaatggtctgattgtggcttttaaaataatttttaaaatcgttgattaagttcacggtctcatcaaaaagtttttcattttcacaacgattcataagcagggtttctgctccaaacatttccggaacttctgttaagacagttgttccgcctttggaaattaacaagtcggaaaatgaaccgacagttggattggcagtgattccggaaagtccgtcacttccgccgcatttcattccgataaccagttcgctacagctgatgggttctcgtttgaaacttcctacatagtctgcaaggtctgcaattacatccagtgcatcggaaatttcatcttcacattcctgagcaaccagaaaacgaacgcgtttttcgtcgtattcgccgatgtatttttttaattcttcgatgttactgttttcgcagcccagtccaagtaccagtacaccaccagcatttggatgattgattaaatcagcaagaatctgtcttgtatgttcctggtcgtctcccatttgagaacatccgtaagggtgtgggaaagcaacgatttcttcaacggttccttttttataaacctgagcctgtcgttcgacagcagttgcgacattgttgacacagccaacggtcgggacaatccagatttcattacgaacaccgacttttccgttgcttcttctataaccatcaaagaaacgttcttcggtttttttgacttccggatgaaccggctcataagtgtaagtaagcaggtcgccaagaccggtgcggatattgtgtgtgtgaatccaggaaccggttgtgatgtcttcttttgcaagaccaatctgtgaaccatatttaataacaggttcgtctgtcttgatatctgttaaggcaaatttgtgtccttgtgggatatcttctgataaagtcactgtctgactgccgagttcgacaaccagtcctttggataatggagcaagagcaactgctacattatcattggaatgaatctttaaatatttttgcattggaaaattcctccattaaaaattgtaagagcttacataaaaaatacaacgaaacgctttaatagtcaatataaaagatgagaaacattaaaaaaagcataattttaggggaaatagacaaaaatagatgggaaagattgtgaaaaaatttgcggaaaagtgtttgctatttcggtgaaagcgttttataattcaaaatgaaatgtaaacgcttacctatgcgtgcaaaaaaaagaaaaaagaaaggaaaatgaaacttatgaagagattaagaagactgtttgtctgcctggtctgtctgtgcgtggttatgagtgctcaaggatgcggttctattgcaggtgtttcaagtggcaagagaattattcgtatttctcatgcgcagtctgaaacacatccggaacatcttggactgttaaagttcaaagaatatgttgaggaaaatctgggagataaatatgaagtccagatttatccaaatgaaattttaggttctgcacagaaagcaatcgaactgacacagaccggagcgattgactttgtagtggcaggaacagcaaacctcgaaacatttgctgatgtgtatgagattttcagtatgccatacttatttacatcagaagaagcttaccatgaaaccatgaacgatactgattacatggaaaagatttatgaatctacggatgatgcaggttttagagtattgacatggtacaatgcaggaacaagaagcttctatgcaaagaaaccaatctatacaccggatgacttaaagggacttaagattcgtgtacagcagagtccggcaagtgttaagatggcaaatgcatttggagcagcagcatcaccgatgagctttggtgaggtatacacagcgattcagcagggtgtcattgacggagcggaaaataatgagctggcgctgacaaacaacaaacacggtgaagtcgcaaaatattattcttacaacaaacatcagatggtaccggatttattaatcggaaatcttaaattcttaaatagtttaagtgatgaggaattccaggtttttaaagaagcagcacgtctttctacagaagtagaaatggaagaatgggatactcaggttcaggaagcaaaagacattgctcagaatcagatgggtgttgaatttatcgacgttgatgtacagcagtttaaagataaagttgcaggtgtacaggaagaaatgttagaaagcaatgaaaacatccgtgatctgtatgaccatattcaggaaattaacaaaaagtacgagtaggaggggtacgatggaagcagtaaagaaaatcaaaaatgggatgaatgcagtcttaagtttcttatgtatcattctctttgcttttatggtatgtgtaggaacctaccagattgtcacacgttttgtttttaattccccgagtacggtatcagaagagcttctgacttatagctttgcatggatggcattgctttcttctgcactggtatttggaaaacgtgaccacatgagaatgggattctgggcagataagctgaccggaacaaagaaaaaagttttagaattggtaattgaattaattgttcttatttttgcagcgagcgttatggtgtacggtggttctaccattatgaaacttacaatgacacagaaaacagcttctcttggaattccaatgggaatcatttacacagttgttccgcttagtggaattgtaattgtaatttatgcaattttaaatatgattgaactgtgcaagggaaatttagaccagccggtggctgaagaaaaataggaggagtctgatttatgagtatagcaattgtatcaggaatcatcattttggttctgctggtcattatgttagtcgcaggtgtaccgattgctgtagcacttggtgtatcatctgtatgtgcaattcttccggttatggatatcgacgttgcggtattgaccggtgcacagcgaattttttcaggaatttcagtatttagtttattagcaattccattttttattcttgccggaaacatcatgaataaaggtggaattgccatccgtctgattaaccttgcaaaattaatcactggacgtactccgggtgcactggctcagacaaatgttatcgcaaacatgctctttggagcaatttccggttctggtacagcagctgcttctgctatgggttctattatcggaccaatcgaaaaagaagagggatatgacccgaacttttccgcagcggtaaacattgcgacagcaccgacaggacttctgattccgccaagtaatgttatgattacttattctttagtaagtggtggaacatccgtagcagccctgtttatggcaggatacattcccggaattttatggggtcttgcatgtatgcttgtaatttacatcattgcaaagaaaaaaggatatcgtgcaaaatcaacatttacagcaaaagaagccggaaaagttatcttacaggctctgccatgtctgcttttgatagttattgtaatcggtggaattattggtggtatctttacagcaacagaaggctctgttgtagcagttgtatacagcctttgcctgtctctgtttgtttataaatccattaccttaaaagacctcccgaaattattcaaagagagtgctgaaatgacaggtatcattatctttttaattggtgtatccagtatcatgtcatgggttatggcatttacaaacattccggaagcagtatcaagcggacttcttgcaattacaaataataaatacattattttcctgctgattaatattatcctgcttgtagttggaacattcatggatatgacaccggcatgtctgattttcacgccaatcttccttccagtctgcagtgcacttggaatgagtaccattcactttggcattatgttaatctttaacttatgtatcggaacaattacaccgccggtaggaacgacattgtttgtcggtgtaaaagtcggaaatgtaaaaattgagacagtatttaagcagttgcttatttactttgcagcgatacttgctgtattattattagtaacctatattccacagcttagtttatggctgccaagtctgatggggtatgtataaagggaaagcgctatcattcacgcaggcgcacgcagtacagtgaaagttaagtgctgttatattgacgcagaataattgcttcagatacaaggcggaggaatgaggcgtagcagtagctacggcgattgacgacaacgcagtagatgaaaaattagacaagtcaggatgacagttgcttaacaatttcactgtacaaactacttgtcgctggcagcggtacataagaggcatagcctctaagtaccggccgctccaaagtgtctgcttgtgaaaagatagctaatcaaaagttccaatggatgaagttacttagtaaagttcaagttgaatgaatgtgaagcttggttcatgttttttggttaaccatattttatattgactataatgaagtgtagtaaaaaatagattgttgatttatttggactaaattgcatgtcaggagtatttgattgataaaaaagtaatgaatggaactttagaagatatctattatgtaccgcaggagagcacctgtggtgaagcaagaaattttatttaaggaggcttttgtaatgaaagcatttatggatcaaaactttttacttgaaactccgaccgcacagaagttatttcatgaatatgcaagtcaggtgccggttttagattatcactgtcatatcaatccgcaggaaatcgctgaggatagaaaatttgaaaacatcacacaggtatggcttggtggtgaccattataaatggcgtcagatgcgttctaacggagtagatgaatattacatcactggcggtgcatctgaccgtgaaaaatttcagaaatgggcagaaactctggaaaaggcaatcggaaatccgctgtatcactggagtcatttagagcttagaaaatatttcggttatgaaggctatttaaatggagaaactgcagaagaagtatggaatttatgtaatgcaaaactgcaggaggacagcatgtctgttcgcaatattattaaacagtctaatgttactttgatttgcacgacagatgacccggtagatgatttaaaatggcatcagatgattgcaaaagatgacagttttgatgtacaggtacttccggcatggagaccggacaaggcaatgaatctggaaaaaccggaatatctggattatgtaaaaactctttctgaagtaagtgaagtaaaaatcgacagcttcaaggctttaaaagaagcacttgtaaaacgtctggattatttccaggcaaatggctgtaaagtatcagaccatggtatcgagtatgttatgtatgctccggcagatgatgcagaagtcgaaagaatttttgccaagagacttgctggtgaagcggtaacaaaagaagaagaattaaaattcaagacggcatatttacagttcatggcagaagaatattataacagagactgggtaatgcagcttcattatggatgcaaacgtgataacaatacaccacgttataagcagttaggtccggatacaggatatgattgcatcaacaactatgcaccaagttctgaaacggcagatttcttaaattctttaaatgtagcagataagatgccgaaagtgattttatattctttaaatccgaatgataatgcagcaatcggaacaattttaggatgttttcaggacagcagtgcaattggtaaaattcagcagggtagtgcatggtggtttaatgaccataaaacaggaatgattgaacagatgacttctcttgcaaatttaggtctgttaagcaacttcatcggtatgctgactgactcaagaagcttcctgtcctatacaagacatgaatatttccgaagaattatgtgtaatttaatcggcggatgggtagaaaacggagaatatccagctgactacaaagcattagaaaaaattgtaaagggaatttcttataataatgcggttcgctattttggatttgacttataagaaaaacaggcttattattaatagaaatactttttgtgaacgcagataagcattctcccgttttaaatgtacggggcacgaaacagtgggtaagggggatgtttatgtcagtgagaacctttcgctctcactgacaggtcgcaaagcgactgcgttcataagcaagttgcgaaggggattgcaaatgtccgctttacagcaaagaggcatggattttaaaactgaaaatccatgcctctttaaagaatcagaatgatagaaagatgaggaaacaaagtcattaacatttacgatatagccagaatttccggtgtgtcaatcgcaacagtttcaagggtggtaaacggaagccagaaagtcagtgaaaagaccagacagaaagtaatggatgtgataaaagcagagggctatacgccaaatatatttgcgagaggacttggacttgattcaatgaaaacgattggaattatgtgtccaaacattgcggataactacatggcaagagcaatttctcacctggaacaaaattttcatgaatatggatatgactgtattcttggatgcagtggacacacaagagaagcaaaagaaaattatgtaaaattgttattatctaagagaatcgatgcgcttgttatggttggttctacttatggtggaaacggagtagaagaaaaggagacggcttatattaaaaatgcgtcaaaacaggcaccggtctttttgattaacagctggattgagggagaaaatatttattgttcgaatgcagatgatttctctgctgcttatgaagtgaccagcgcattgattcgccgtggaaagaaacggattttatttttgtatgattcggagactttcagtgcaaagcagaagatggagggctacgaaagggcgctttccgatgccggctatccggtacttggagatttgaagttccgtaccaaaaacgaaattcatcatgcaagagatttgatgcttgcgtataagaatctggagtttgacagtgtatttgcagtagaagacgggcttgctgttgctgctttaaagtatgcaaaggtaaaaggaatttcggtgccggaagaactttctgtggttggatataataactcaccgctttctgtaagctgtgagccagaactgacttctgtagacagccggattgaacagcagtgttacatagcggtggaaaacattgtaaaagtgttagagggaaatacagaagtttcacaccgtaccattgtgccgtgtgaaatcgttaagcgttgtacgacagatttctgattcatttttgtaaaaaaagattaaaaaagaacgcttgacaaattaaaacacaatgctataattgactcatcaataagaaaatacgttgacgagatgagtaagatgtggaaacgtttcagagagaggcagccggaacttccggtgctggaactgccttagcgggaaccatccgaaaactacctctgagtgaccccaatccggtccggtgattccgttatcatcaaaatgaagtggtttgaaaatcagtgtaacagctgatttgtttagatgaaaagcaaaaagggtggaaccgcgggtaatgtctttgctcgtcccttgcatgaaaatgcagggatggacaaggactttttttattccataaaaatctctgcgaaatagataatgatattgataaatgtaaatgtacttttggaaagtattctgcaagagcaggggaaagaaagattctaagagtgcataaataaaaaacaggaggaaaaaagttatggttatcacattaaaagatggttctaaaaaagagtatgaagaagcaaaatctgtaatcgacatcgcttatgatatcagcgaaggtcttgcacgtgcagcttgtgccggagaagtggacggagaggttgtagacctgcgtactgttgtagataaagactgtgaagtaaatattttaacagcaaaagatgagaaaggtcttgcagcactgcgtcatacggcatcccatgtattagcagaagctgtacagaaattatatccggatgcaaaagttgcaatcggaccttctattgatacaggtttttattatgattttgagtgtcagccgttctcaagagaagcgctcgatgaaattgaaaaagaaatgaaaaaaatcatcaaaaaaggtgcaaagattgagcgtttcacaaagacaagagaagaagcaatcgcatttttcaaagaaaaaaatgagccttataaagtagaattaattgaggatcttccggaaggagaagaaatcagcttctattctcagggagactgggttgatctatgtgcaggtcctcatctgatgagcacaaagggtgtaaaagcatttaaattgctttcttcttcaggtgcttactggagaggaagcgagaagaatcagatgctgactcgtgtatacggaactgcttacggaagcaaggatgaattaaaagagcatctggaacagcttgaagaagcaaagaagagagaccacaacaagctgggtcgtgaaatgaaattgtttacaacagttgatgtaatcggacagggtcttccactgattatgccaaatggtgtaattatcatgcaggaacttcagcgctggattgaagatgaagagacaaaacgtggttatgtccgcacaaaaactccgctgatggcaaagagtgatctgtataaaatttccggtcactgggatcactataaagatggaatgtttgtattaggtgatgaagaaacagataaagaagtatttgcacttcgtccgatgacctgtccgttccagtactatgtatacaaagcagaacagcacagttatcgtgatcttccactccgttatggtgaaacttctactctgttccgtaacgaagattccggtgaaatgcatggtctgacacgtgttcgtcagtttacaatttctgaagggcatctgattgtaagaccagaccagatggtaaaagaatttaaagattgtattgcactggctcagtactgtttacaggtacttggtgtagaagaagatgtaacttatcatctgtcaaaatgggatccggaagacaaagaaaaatacatcggcgagccggaagtttggaatgaaacagaagaacacatccgtaatatgttacaggaattaaatattccattcgtagaggatgtaggagaagctgcattctatggtccaaaagtcgatatcaatgcaaagaacgtttacggaaaagaagatactatgattacgattcagtgggatgcactgcttgctgaacagtttgatatgtactatattgatgaaaatggtgagaagaaacgtccttgcattatccatcgtacatctgtgggatgttacgaaagaactttggcatggttaattgaaaaatatgccggcatgttcccgacttggttatgtccggaacaggtgcgtgtgattccgatttctgaaaaattccatgactatgctgcaaaagtagaagcagagttaaaggaaaatggtatccgttgttccgtagaccagcgttctgaaaagatgggatataagattcgtgaagctcgtcttgcaagagtaccatatatgctggtagttggagcaaaagaagaggaagaaaacaaggtatctgtaagaagtcgttaccttggagatgaaggtgcaaaagatttagcagatttcatcggtgcaattaaagaagaaattaaaaataaaacaattcgtaaaattgaagtagagaactaataatctggggatatcggtgagtggcaaaatttacttttgacactcatatcgtaaaatatttcagataagagaaaggcatttatttgttgaaaggcagataaatgtctttttcattttattaaaatttaaaatcttctattgacaaatacctaatgggggtatatagtgaagatacccacagggggtatttgaagttgaaaaatcctatagttgtacaatgcgaactaccacacgccataaaggcatgtggttttatggcgatagaaacttataaaggagcgtgtatgtagatgtctgaagaaaagagaggctgttgttgtggcaaaaagacaacaatgcgttcggaagaggaacgaaaaaaattaatcaaccgtctaagcagaattgagggacagattcgtggaatcaagggaatgttggaaaatgatgcgtattgtaatgatattctggtacaatcagcagcagcgagcgcagcaatcaatgcatttaacaaggaactgcttgcaagccacattcattcctgtgtggtcagagacattcgggaaggaaaagatgaagtagtggatgaattagtagctactttgcaaaaactaatgaagtaaaaattacaaactgcaaattagaaatgaaaaacagagagaggagttgaaaaaagttatggaacagtatacggtaaccggaatgagctgtgcagcttgcagtgccagagtcgaaaaagcggtttccaaagtaccaggtgttacttcctgttcagtcagtttattgacaaattcgatgggagtagagggaagtgcagacccgacaagtattatttcagcagtggaagcggctgggtatggtgcatctgtaaaaggagcagataaaaaggcgaacacgctggcagcagatgaggcagcgctggaagataaagagacgccggttttaaagagacgtctgattgcatcggttggatttttgctggtattgatgtatttttccatgggacacatgatgtggggctggcctttaccggcatggtttcaggacaaccacattgcaatgggaattgtgcagatgattctggcggcaattgttatggtgattaaccagaaattttttattagcggatttaagagtttatggcacagagctccaaatatggatacgcttgtggcaatgggttcgatggcatcgtttgtatggagtgtctatgtactgcttgcaatgacaagagcgcaggtagatggaaatatggatgccgttatgaattatatgatggatttttattttgaatccgcagcgatgattctgaccctgattacagtcggaaaaatgttagaagcaaaatcaaagggtcggacaacggatgcattaaagagtctgatgaaacttgcaccgaaaacagccgtgcttgtaagagatggaaaagaagtaatggtttctatcgatcaggtacaaaaaggtgatattttcgttgttcgtccgggagaaaatattccggttgatggaagaattttagagggtcacagtgcagtcaatgaatccgcactgaccggagaaagtattccggtcgataaagaaacaggagatttggtttctgcggcaaccatcaatcagtcaggatttattaaatgtgaggcaaccagagttggagaagacacaactttgtctcagattatcaagatggtgagtgatgcggcagcgacaaaagcaccgattgcaaagattgcagataaggtttccggtgtgtttgttccggcagttattacgattgcagtcattacaaccattgtctggctgattgcaggacagagtgttggatatgcgttggcacgaggcatttctgtactggttatcagctgtccatgtgcacttgggcttgcaactccggttgcaatcatggtaggaaatggaataggtgcaaaaaacggtattttatttaagacagcggtttctctcgaggaaacaggtcgtgtgcagattgtggcactggataaaaccggaacaattacaagtggagagccaaaggtaacagatatttatccggcagatggagaaaatgaagaaagtctgttaagagaagcggcaattctggaacaaaaaagtgagcatccgcttgcaaaagcgattttggaaaaggtgaaagaaaagaaatggatgcttgaagaggcagaggaatttgaggcgctcccgggaaatggtttaaaggcatcttataataagaaagaactgcttggtggaagcatgaaatttatgcaggagcagattggaatttccgaggaaatgcagaaacaggcacagcattttgcaaaagaaggaaaaacaccgctgttctttgcaaaagagcagaaactgcttggtatgattgccgtggcagataccataaaagaggacagcccaagagcagtcaaagaattacagaatatgggaatacgtgtggtgatgctgaccggagataacgagcggacagcaagagcaatcggggcacaggctggtgtggatgaagttattgcaggtgtgcttccggatggaaaagaaagtgtgatccgtaagttaaaacaaaaaggaaaagtggcaatggtcggcgatggaatcaatgatgctccggcactgacaagagcagatatcggaattgcgattggagcaggaacggatattgcaattgatgcagccgatgtggtactgatgaagagtcggttaagtgatgttccggcagcagtgagactcagccgtgcaactttgaaaaatatccatgagaatctgttttgggcatttttctacaatgtaattggaataccgcttgcagcaggtgtctggattccgatttttggctggaccttaaatccgatgtttggagcatttgcaatgagtctttccagtttctgtgtcgtatcaaatgcattgagattgaatttatttaaggtaaaagacgcgaaaaaagataagaaattaaaaagtgaagtcagcgtatccgaactttctctgacacagacagatggtgaaacaaagactttgaaaatcaagggtatgatgtgtggtcactgcgaagcaagagtcaaacaggcattagaaagccttgagggagtggaagaggcaaaagtaagccatgaagccggaactgcggtagttattttaagtgcaccggtggatgagaaactcatgaaacaaaacgtggagaaagagggctataaggtcctttcgatcaaataaaaaataagagaggtataaagctatggtaaaaacaacacttggaatcgatggaatgatgtgtggaatgtgcgaaagccacatgaatgatgcaattcgcaataactttgatgtaaaaaaggtaacatcttctcacagtaaaaaacagaccgaagtgatttcagaagaagcattagatgaaggaaagttaaaagaagtagtagaaaagactggctatcagttgacttctgtagaaacagaaccgtatgaaaagaagggattttctctgtttcacagataagaaaatagtaggaactgttttttagaaaaacgatagaaaggacgttgtggagagcagcgtccttttttcttttggcttaagtaagaagaacattgattttcctttaacacaagattataataaaaaataacgaaattttgagacgacaaaaaggagaaaacgagtatgatagcagataaaatgaaagcacttgtaaaaaacagctcagcaattcgtgccatgtttgaagaaggaaaaataatggcagcaaaatacggggcagaaaacgtatatgatttcagccttggaaatccaaatgtgccggcaccggttcaggtaaaagaggcaattatcgaggaagcagagagagaagacccgattgtactgcacggatatatgagcaatgcaggatatgaggatgtgcgtcaggcagtagcggaatccatcaataaaaaatttgatactgcgttttctgcaaaaaatattattatgacagttggagcagcaggtggtttaaatgtaatcttaaagacattattaaatccaggagatgaggtcattgcaattgctccatattttggagaatacaacagctatgtttcaaactttgatggaaaactggttgtggtaagcccgaacaccgagactttccagccaaatcttacagaactcgaagaaaaactgactgcaagaacaaaggctgtcattgtaaattcaccgaataacccgactggagttatctattctgaagaaaccattcaggcaatggcagaaattcttcgtaagaaacaaaaagaatttggtacagatatctatctgatttccgatgagccgtatcgagagctggcttatgatggagcagaagtgccgtatttgacaaaatattatgaaaatgctatcattggttattcctttagtaagtcgttgtctcttccaggcgagagaattggttatcttgttattccggatgaggcagcggattcagaggatgttatttctgccgcaggtactgcgacacgtattttaggctatgtcaatgccccgtctctgatgcagaaagcagttgcgaaatgtttggatgcacaggcagatgtgccatattatgacagaaacagggaagatttatataatggtttaaaagagatgggatttgaatgtattaaaccgcagggagcattttatttatttatgaaatctccggttgcagatgaaaaagtattctgcgaagcggcaaagaaacagcacattttgattgttccgggttcttcttttgcctgccctggatacgtacgtattgcttactgcgtagcacatgaaacgattattaattccatgcctggattcaaggcacttgccgaagaatttttaggctagtgtacggtatcattgataagtacactaaaaagaatgcgtttgtaactcctgtaaaaaagagagcacaagtgcattttggaaagttacaggaggaaagaatggagtcaattgtacattggtttgccgcaaatatgccgtcttttttatcaccggaggttgccgtttttcttgtctcgatggtgccaattctggaacttcgaggaggactgctcttagcaacacttttaaagattccgatgacacaggcgattgtaatctgtataattggaaatttaattccgataccgtttattctgctttttatcaaacagatttttaaatggttaaagaaaacaaaactctttcgcccacttgttgaaaagatggaaagaagagcgatgggaaaaagtgaccagataaaacggtatgaattctgggggctggttttatttgtaggaattccgcttccgggaacaggagcatggacaggctctttggttgcttctttattagaagttgatttgaagaaatctgttccggctatcttactcggactttgcatggctacggtaattatgtgtatcgtgggttatggagctcttggttcgattttatcttaaagtgaaaatgcgttgtagaagtcagaaagatttctacaacgcattttttaattgaaaaagaaaaactaaatatatatagattggaaagatacaaagtatgaaattactttgtataaaatcctataagatatgcaatcctataatagaatagtagaaagtttgccttaaatcagtcttagatttttctcatccaagatacttttacaaattttatattaagcgtaatttatacttttgtcaatctttttggaagtttttgggggatttaaaagcctacaaactgcttttttgtgcattttgaactatattagtggacttttttggtttaattgccgtcagaaaagttgtcaaacgcccaaacaaaaaagtctttataaagcctgtcataaggaacttaaaatatttacgaataaaaaaaggaatacctggtggcatattgttttttgaataattaagaatcataaaccgtcaaaaaactcgtcagatttttcgtaaaacctaaggaaataaggcataaacagagggtgtatcttggatgagaaaaatctaagatgcaccttaaaaattgcatgaagatagatgtcgaagagtgtaaatctctggatagaatgtctggagtgatgcaattagtaggtaataatgttggtgatagctgtgtttataagtatgaaaatacttagaacggaatccggttagaatccggagcagatcctttccctgctgtaaggacaacgaaagatgtaaaaggtcactgaataaatttcatttggtaagacacattgagtaggttaagaggtcctaagccagaagacgaagcacaaaaaacatttccaacaggaagtaagtaaattcggaggccaggaacgaatcgaatgaaaaacagaacaaaaacagaccctatcttttggataaggtgtgatgcagggttgaaagacctgcagttttttagtaagaattggttcgtagaatggctttcattgtacgagctttttttatggaaaaaatgaaagaaatggaaggaggagagaaaattttaagacgaaacacaaaaattcaggtggataaaacgaaagggggaagtgccatcaaagaaaaataagtttattggttttatgaagaaaaagaatcgtttttaatcaaatagatggagagcatgaagaatgaaagaaaagaaacaaatgagaagattgcttggctgtctgcttcttatggtgtgtttgcttggctgtttcaaagtaagcgtttatgcagcggaaaatgaaagagtcatcaatgttacaggaattaagactgtaaaaatctatacagcagataaaaagcaggaaattgaagtaaaggaaaacagctttacggcagtccctggagagtactgttatgagtatgtgggtggtggttcagcaaatggagcaggtggatattttacagtaacagaagatacaacggagttaaatctcagcagtgttacgttttcgaatgtatcgcctacttattttgataaggaagatggcaaatggaaatatcttccagaattgggaaccttaaccctgtatgatgaaaaacaggagaaggaatactggcatggtacagatgatgtatataattacattgtgccaaattgcggtggagatagttattataattttacatttacaccgtttgatgaaaattatcttccagtcgaaggtcatttttatgtttatggagagacaagctttggagcattaaatctttcagatagtgggaagattccgtatctgaaaaaaagttatattacagtcaaggcaccagtggatatggaagtgtatacgacttgggaattgaaattctatacagccagaaactggaaatcctatgaagcatataagactgaagatggttataattattacaaaattccagaaggcttcacgtatatgatgcgtcaggaaggaaaagtgactcgttatactaaaaatctaaatggggaatggaatgacgaccataccgaggtcacagttgcaccgcttgaggataatccaacacaggtacatagagaacaggaaaaagatggaatttatgccagcatgttaacgaacctgccggaaaacagtgagattgatttagaggtaggggaatactttgacctggtaccactgcgcgcatggcaagcattggaggatggtgtgagtaattaccataatgacccagactggcattatgtagttttgggaggaaaaacggtatctgttgaggtaacggaagatgataaaatagggcagtttggtcgaattcatgcaaatggtaaaggaacagccttagtagcattttattatgatgctgtggagacatcttcttttacgagtgatacaggaagttatctttatagtgcactgttgcctgaattggcaggaattgctgttgtacgtgtgggagaagaaactcctcagactcagattagttctaatattgatatgatagaggggcgtacagtttattatctgaagagccaaaccggagtagatggtaatacgtatgatttaaataattcggctgaatatacttttacgcctacggctaaaacaggtgataaagaggaaaaaattacttctgtaaaagtacacaaaccgattacagtgactgatggtataataggctgtggcggaagtacgaaatggaatcctaaaaactggttaaaggatggaaagtggacaacctatcaggcaaatgaaacagaggatggaaaacaaagttatacaattcaattagcagaaggacgtaatattgtagagataaaagcaggtgatgcaactacctatcatgtcattctggcccgtggtgtagatgtgacgattgataatgtatatcgaccaagacaaagcttactggatggagatactgtaaaggtaacgatagaaaatatgattcctccattatttaaaatgtcagcaatctataaccctgcaggtgtagattttgcttgtaaagcgaatggagtggattatacagggcattttggacagtacatggtaggaagtagttttaatataaaactagaggaagaggatgtaggcacttacaagattacggatggagcgttaacaactcatgcgtggggagcaacagatggtacacaccgcaaattgacaagaaatgcgatgtcaggttattggaatggtgggaataatccagatattgattatggaaaactggcatatattccagagatatcttttgaggttaaatctaacgatgaatatgaagaaagtgagaggcgttcagcaggattattaaaagccttgggagtatctttaaataaagttggaaatccaatgagtacaagcaatgctatgtttaagacaagcaattcagatgtgaaacagaataagaattgtccaacgtcattatcatcgttcttaacgttacctgttcaagttggagcggaattgctccaaaatgatgaagaagcaaagttaatgataagatattggcgaggagacgacaggaataatgcacttgtacaagagatagatttttcaaagattatatatagtagtactactggctcgccgctcatagttggaaatccattaaaatatacggggcaggagttagcagatggtgtatcaaaagatatacaggtagaagctattgtagttcctggagaaggaagtcctatgacgtatgctacatacatatatgattctagtagtaatacgaaagatgttacaggattttttattccaaaagatataacaatctcttctgctggaggaagcggagaacttggtcgttgggatggaattttggaagcagatgatattacatataaggattcagaaggaaatgaggtaacacaggaccttggatatggatttatcggaacagaagaacactttactacatctgtgccaaatggaacagataaaattctggtaaatgtagagggagaagttgcagttaatgcgaagtatctggaaagttatagtgtttcttttgatggaaaaacctatgaaaatggggaagcgattcctctggaagttggtgtgaacaaactgactgtgacatgcaacggaacgtatggaaaatctcgtacctacaccatcgacgtcactcgtcgtaccgctgcaaaacagacaacctttgaagttccagaaggagcctctgtacttgtaatgcagggtagtaaagtgatgaaagccaacgaagatggaacatacacccttgaaaatggaacatatacttactatgtatctaagagtggattcctgaccaagacagacagcttcaaagtaactgatgaggaaaccaatccggttatccgtgtggaaagtttagaagcagttccggctcagtctggaaccgtatcggtacagcttgccggtcagagtacggtattctgcccgacaacagatgtaactgtttcacaggaagcaaaagacctggcagcaaatcgttatgtcttatataaccatggtggttacaccgtacttcatgcattgttggatgcagcaaatgcaagtggaaccagttttgagtgttataaaggaaaactggtactggtagacgattcaattacagaaaacaatggaaagaaatccggatggatttgcaaggtaaatggtgtggtatgcgaggacccagccaatactttagcatccgacggagataagattgagctcttctataattctggatgggatggcatgaaggatgcacatctgacaccggaagtaaaagcagtgaacagaggagaaaccgtgactctgaccttagcaggagcaggtgtttccgaaaatgatgcaaacgcagaagccattgcggatgcagagatttatgaaggaagtacactggttggaacaaccaacgaaaatggacagcttgagttagaaaccaataccctttctttaggaacccatcgttttacggctgtaaagaaagatgaatccggtcataacattttaactgcagtcatgagttcgattaccgtaaacaaagtaagtgacccatctgcagacccgaacaagaccgttgttacattccgtctgattggtgataccaaacacggagaagagggaagtgacaacgaggcagttcatgcgtataccacatggattgcaactggtacttatacatttgaccaggcagaagtaaccgttggtgacgtatttaagactgcattggatgaggcaggactttcttatgagggaattgaaaagaattatatcagttccattactgcaccggaaatctatggttcttatgaattaaaggaaatggataacggtaaaaattccggctggatgtatacggtaaatggagttcatccagataaaggtctgaatgaatggtatgtgacaactggtgatgaaatcgtatggcattacattgatgactataaagtggaacaggctgacatgaaggatgattctggaaactatgcaacaggcggaaatgcttctacctggaataaatggctcgaagcagtcgatgaaactcctggtgcaaaggaaaatgcaatcaaagtcatcaatcagattaaacagattgacgaaacgattgaactgacagatgagtgtgaagcaaagattaccacagcacgtaaggcttatgatgccctgacccgtgaggaaaagggttatgtaaataattacgatgtactcttaaaagcagaggaacaactgtctgcccttaagaaagaaaaggcagataaagaagcagcggaagcagtgattgcccagattgatgcgcttccaacagccgaaaatgtgactctggaacatcaggaagcagttgatgctgcaagagatgcgtacagcaagctgactgatgaccagaagaaactgatttccaaggaaacaaccgacaaactggaaagtgcagagaagaagattgcacagttactcgaagagcaggcagcggatttggtattagaagagattaatgcgcttccatccaaagacaatctgacccttgatgatgaagtggctcttgcaggagcagaggcacactacaatgcattaagtgattcccagaaagagtatctgacaggaaaagcagcggaaagtgttgcaaaacttggtgaattaagaacgcagttagaaaaactgaaaaaggatgcggcagacaaagcggcagccgatgcagtgacagaaaaactcaatgcccttccatccgaagaggatgtgatgttccaggatgaagcagtcctgaaacaggcaagagaagcttatgaacagttagatgatacacagaaagctctggtttccagtgaagcgtatgacaaactggaaaaggcagaacagaaactggaggcattaaaagccgaagtcgaagcggtaacaaaacagattcaggaacttccggcggttgaggatttaacactggaagatgcagaaaaagtatcttcggcaagaagtgcttatgatgcgttaaatgcagaccagaaacgtcagttaacagaaagtggagtactggatacgctgttaaccgcggaaaaccagattagcttacttgaaagagaaaaagaagaagcagaaaaagtggcacagcagattaacagtctcccagaagtgaaagatttgcagctggcagacaagacagcaatagaagaggcaagaaaagcttacgatgccttaagtgacaatcagaaagcaatgattgaagatgcaaagacagcacttgaggaaagagaagcagaaatcaaacgcttagaagaactggcagataataccgataaaccagacccagacaataaagaggatgataagaaagacgacaacaaagataacaacaaagataacaccacagacaataatacatcaacgacagataagaataataatggttctggaacaacaaccggtacaacgaacaaaggctctaacacaaccacaggtacgacaactggtacaacaaccaataaaggtactcagagtggaagcaccaataagacaacaggaactacaactacaacaggaagtcaggcacagacaagcagcaaacagggaacagacagcagtgtgaagagtgccaagacaggagatgaaaccgatttccttcttccaatggcaggactgattagtgcttcaggtgcatttgccggagtgattctctattacaagaagagaagaaaagacacaggagtagagacaaaagaagagaaataaaaaccaattgaacactccttattagaatcccccatacttttggaagctttccagagtatgggggatttttttgtttcatttgatagcaaagcttgttttgtattgattcggttatgagcaagtagcgaagcgaattgcgaatatccgtttgacgtcgaaggtaagcaggaatggatttagtggtgtttttatttcgttttaagaaaaaattcactaaacggtcattctttttctgacaggatatggtatcataaaagaaaaaataaaagaaaaaatccgtggagtgttttaagatgcttaaaaacgggaaaggataaagattatgaataagcgggaatttttggaaacactaaaagaagcgctttctgaagagatgccggcttctttggtaagagagaatgttcaatattatagtcagtatatagatggagaagtggagaagggctgtacagaaaaagaggctgtggaaaagcttggagccccgagactgattgcaaaaacgcttttagaggcgtttgaaacgacagggcagacttatggctctgatggaaaccaaacagcgtatcaggataaatatggacggcagaatcgttcagaaggggattatggaacgacagatggagactgggcaagtgagagtattaaaaaccatatcaaattttcaaaacaggcgaagattcatctgataataggaattttaattgcagtctgcgtgattgtattgattgtcagtctgattagtgccctgcttccgattgtactgccggtacttgctgtactgcttgcattatcttatctgcagaaaaagctttaaccgattaggcaagcggcgcagcagactgtgaatatccgcttgataaaaagccggaaagggcagagaaaaacggcacagaaaactcagaaaaaatagaaaagaacaaaaaaagaaggtcttgataggggagctaccaagacctccgaggggagtataaataattaaataaggggttataatgtaaaaaaaatttttgaagggtaaattctttttacaagtgatattataatataaaaagggaaaaaaagcaatgtttttcatctttctttttagaaggttgacaaatattgtcttattgcacaaaaagaaaaaaaggtttgacagaacgtaaaaagaggcattgaaatttatgatttcaatgcctcttttgggatgtagggttaaagttttgttgtatcagacatcagaaaacgatagttgaaattccaattaaaatgccctgtgtaagaagcagtacaaggaagattggaacgatgaatttccaccatttttcaatctttacaccggcgattccgcacatgattggtgccatggcggtcggccatacgatattggaaagtccatcgccgaactggaatgccagaacagatacctgacgggaaacaccaactaagtctgcaagaggagccataatcggcatacttgtaaccgcctgtccggaaccggatggaatcaggaagtttaataaggtctgaacaacgagcattgcctctgatgcaacccaggatgggaagtagtgcagtggaatagagattccataaacaatggtatcaatgatgtgtccggattgtaatacaaccagaatacctcttgagaaaccaattatcatacaggcgactgcgatatcagtaaagcttgctgccatcttttcagcgatggtatttggtccccatcccatgataagggagcttacgattcccatgattaagaaaacagcagataagtcttcaaagtaccatccttttactttaacaccccatacaatgactgcgataccggcagcaagagtggcaagtactaatttttcacgaataccaaatgggtgattttctacttcttttgcatcaatggttaagtgactgaagtcatcgccatatacaaggctctttgtcgggtcagcctgaatctttaaggcatagcggacaacaaagatagaagcaacaacaatcatggcaaggtggcagataatacggtatccagcaccggatagctgctgtaatccggcgatgctctgtgccattccaacggtaaatgggttcataaccgcaccgctgtatccaagtccaacaccaagagcgacaattgcaagtccgacaacagcatcataacccatggcgattgcaattccaacaaaaattggaatgaatgggaaagcttcttcaaaaacaccgatggtagaagaagcacagccgagaaccagaataaaaaccggaataataatagccctcgcttttccctgaagtatttttaaaagtccggcaaccagtccgttaaaggctccggttgagataattaaactgattgcagcgtaagcgataaatacgaagaagataactccgccaccgtttaacataccattgtaaatggcttttacagtttcaaaaggtccaaccggtgaagaatcaacagtgtggtaagttccgggaacaactacttccgttccggcttcgttcacctgacggtcaaattctccggctggtaaaatccaggttgcgaccgcacagacaacaatgatagctgtcagcagtacgaagatgtgcggaagtttgaattttttcttctttttcgtttctgtacccataatcaagtcctcctcatctgctagtcagattgtttgttctttaattctttctgccatgcttcataaacagtactgcggaaagaatcgtcattaaatattttcagagataaatcagccagacaacatgcgccttttgccattgcatcgtgcgcctttggttttaatgtggcatcacggaaatctctggtatgcagtgcaaaattttcatctgtgatagaaagcatggattgcattgcaggacagcggtagctgatatttccaacgtcagaagaaccggaagccggtggtacatcacctacttttaatccataacctgccatcagttcggttattttattttccagaggataatttcttaccatatctgcaaaatcagagagtccaaaggtgagtgttaccgtacagtcaagtgccattgcagcggcatttgcacattttttaatcatttcatctactttttctaatcggctcatggaagcagtacgaaattccattcgtattttactatagtccggaataatatttggagcttttcctccatctaagataaccgagttaacatgaatatccggtgtgaagcattcccgccttgcgtcaattaaatcaagaaattttcttgcagcggagagggcacttttgccattccatggagcagcaactgcatgagcggtttctccaaagaattcaacttcataacagcgcaggcttaaaacgtccatatctggaagagaatatccgcctgaactgctgtgcatcataactgccattgacatatcatcaaagattccctgttctgccattccaatttttgcaccgttttcttcttcggcaggtgttccaatgacataaagtgttcctttgaatttatcttttaaatccattaaagcaagaccggaaagtacggagagagaaccgtgaaggttatgaccacagccatgtccgatttccggaagcgcatcgtattctgcaagaagtgcaacggacggaccatcgccgttatcaagtttggcacaataagcggtgtcatatccagcataaggataggtaacttcaaatccggcttcttttaaaatttctgccatttttcggctggattcaaattcctggtaaggaagttccggatgctcggctaaatctttgcttaaagcaattgccgtatcaagatgtttgttgacggcttctttaattttttcttttaattcactcatgggaatcaactccttcttctgtcacattacaagtgatattataatataaaaagggaaaaaaagcaatgtttttcatctttctttttagaaggttgacaaatattgtcttattgcacaaaaagaaaaaaaggtttgacagaacgtaaaaagaggcattgaaatttatgatttcaatgcctcttttgggatgtagggttaaagttttgttgtatcagacatcagaaaacgatagttgaaattccaattaaaatgccctgtgtaagaagcagtacaaggaagattggaacgatgaatttccaccatttttcaatctttacaccggcgattccgcacatgattggtgccatggcggtcggccatacgatattggaaagtccatcgccgaactggaatgccagaacagatacctgacgggaaacaccaactaagtctgcaagaggagccataatcggcatacttgtaaccgcctgtccggaaccggatggaatcaggaagtttaataaggtctgaacaacgagcattgcctctgatgcaacccaggatgggaagtagtgcagtggaatagagattccataaacaatggtatcaatgatgtgtccggattgtaatacaaccagaatacctcttgagaaaccaattatcatacaggcgactgcgatatcagtaaagcttgctgccatcttttcagcgatggtatttggtccccatcccatgataagggagcttacgattcccatgattaagaaaacagcagataagtcttcaaagtaccatccttttactttaacaccccatacaatgactgcgataccggcagcaagagtggcaagtactaatttttcacgaataccaaatgggtgattttctacttcttttgcatcaatggttaagtgactgaagtcatcgccatatacaaggctctttgtcgggtcagcctgaatctttaaggcatagcggacaacaaagatagaagcaacaacaatcatggcaaggtggcagataatacggtatccagcaccggatagctgctgtaatccggcgatgctctgtgccattccaacggtaaatgggttcataaccgcaccgctgtatccaagtccaacaccaagagcgacaattgcaagtccgacaacagcatcataacccatggcgattgcaattccaacaaaaattggaatgaatgggaaagcttcttcaaaaacaccgatggtagaagaagcacagccgagaaccagaataaaaaccggaataataatagccctcgcttttccctgaagtatttttaaaagtccggcaaccagtccgttaaaggctccggttgagataattaaactgattgcagcgtaagcgataaatacgaagaagataactccgccaccgtttaacataccattgtaaatggcttttacagtttcaaaaggtccaaccggtgaagaatcaacagtgtggtaagttccgggaacaactacttccgttccggcttcgttcacctgacggtcaaattctccggctggtaaaatccaggttgcgaccgcacagacaacaatgatagctgtcagcagtacgaagatgtgcggaagtttgaattttttcttctttttcgtttctgtacccataatcaagtcctcctcatctgctagtcagattgtttgttctttaattctttctgccatgcttcataaacagtactgcggaaagaatcgtcattaaatattttcagagataaatcagccagacaacatgcgccttttgccattgcatcgtgcgcctttggttttaatgtggcatcacggaaatctctggtatgcagtgcaaaattttcatctgtgatagaaagcatggattgcattgcaggacagcggtagctgatatttccaacgtcagaagaaccggaagccggtggtacatcacctacttttaatccataacctgccatcagttcggttattttattttccagaggataatttcttaccatatctgcaaaatcagagagtccaaaggtgagtgttaccgtacagtcaagtgccattgcagcggcatttgcacattttttaatcatttcatctactttttctaatcggctcatggaagcagtacgaaattccattcgtattttactatagtccggaataatatttggagcttttcctccatctaagataaccgagttaacatgaatatccggtgtgaagcattcccgccttgcgtcaattaaatcaagaaattttcttgcagcggagagggcacttttgccattccatggagcagcaactgcatgagcggtttctccaaagaattcaacttcataacagcgcaggcttaaaacgtccatatctggaagagaatatccgcctgaactgctgtgcatcataactgccattgacatatcatcaaagattccctgttctgccattccaatttttgcaccgttttcttcttcggcaggtgttccaatgacataaagtgttcctttgaatttatcttttaaatccattaaagcaagaccggaaagtacggagagagaaccgtgaaggttatgaccacagccatgtccgatttccggaagcgcatcgtattctgcaagaagtgcaacggacggaccatcgccgttatcaagtttggcacaataagcggtgtcatatccagcataaggataggtaacttcaaatccggcttcttttaaaatttctgccatttttcggctggattcaaattcctggtaaggaagttccggatgctcggctaaatctttgcttaaagcaattgccgtatcaagatgtttgttgacggcttctttaattttttcttttaattcactcatgggaatcaactccttcttctgtcacattacaagtgatattataatataaaaagggaaaaaaagcaatgtttttcatctttctttttagaaggttgacaaatattgtcttattgcacaaaaagaaaaaaaggtttgacagaacgtaaaaagaggcattgaaatttatgatttcaatgcctcttttgggatgtagggttaaagttttgttgtatcagacatcagaaaacgatagttgaaattccaattaaaatgccctgtgtaagaagcagtacaaggaagattggaacgatgaatttccaccatttttcaatctttacaccggcgattccgcacatgattggtgccatggcggtcggccatacgatattggaaagtccatcgccgaactggaatgccagaacagatacctgacgggaaacaccaactaagtctgcaagaggagccataatcggcatacttgtaaccgcctgtccggaaccggatggaatcaggaagtttaataaggtctgaacaacgagcattgcctctgatgcaacccaggatgggaagtagtgcagtggaatagagattccataaacaatggtatcaatgatgtgtccggattgtaatacaaccagaatacctcttgagaaaccaattatcatacaggcgactgcgatatcagtaaagcttgctgccatcttttcagcgatggtatttggtccccatcccatgataagggagcttacgattcccatgattaagaaaacagcagataagtcttcaaagtaccatccttttactttaacaccccatacaatgactgcgataccggcagcaagagtggcaagtactaatttttcacgaataccaaatgggtgattttctacttcttttgcatcaatggttaagtgactgaagtcatcgccatatacaaggctctttgtcgggtcagcctgaatctttaaggcatagcggacaacaaagatagaagcaacaacaatcatggcaaggtggcagataatacggtatccagcaccggatagctgctgtaatccggcgatgctctgtgccattccaacggtaaatgggttcataaccgcaccgctgtatccaagtccaacaccaagagcgacaattgcaagtccgacaacagcatcataacccatggcgattgcaattccaacaaaaattggaatgaatgggaaagcttcttcaaaaacaccgatggtagaagaagcacagccgagaaccagaataaaaaccggaataataatagccctcgcttttccctgaagtatttttaaaagtccggcaaccagtccgttaaaggctccggttgagataattaaactgattgcagcgtaagcgataaatacgaagaagataactccgccaccgtttaacataccattgtaaatggcttttacagtttcaaaaggtccaaccggtgaagaatcaacagtgtggtaagttccgggaacaactacttccgttccggcttcgttcacctgacggtcaaattctccggctggtaaaatccaggttgcgaccgcacagacaacaatgatagctgtcagcagtacgaagatgtgcggaagtttgaattttttcttctttttcgtttctgtacccataatcaagtcctcctcatctgctagtcagattgtttgttctttaattctttctgccatgcttcataaacagtactgcggaaagaatcgtcattaaatattttcagagataaatcagccagacaacatgcgccttttgccattgcatcgtgcgcctttggttttaatgtggcatcacggaaatctctggtatgcagtgcaaaattttcatctgtgatagaaagcatggattgcattgcaggacagcggtagctgatatttccaacgtcagaagaaccggaagccggtggtacatcacctacttttaatccataacctgccatcagttcggttattttattttccagaggataatttcttaccatatctgcaaaatcagagagtccaaaggtgagtgttaccgtacagtcaagtgccattgcagcggcatttgcacattttttaatcatttcatctactttttctaatcggctcatggaagcagtacgaaattccattcgtattttactatagtccggaataatatttggagcttttcctccatctaagataaccgagttaacatgaatatccggtgtgaagcattcccgccttgcgtcaattaaatcaagaaattttcttgcagcggagagggcacttttgccattccatggagcagcaactgcatgagcggtttctccaaagaattcaacttcataacagcgcaggcttaaaacgtccatatctggaagagaatatccgcctgaactgctgtgcatcataactgccattgacatatcatcaaagattccctgttctgccattccaatttttgcaccgttttcttcttcggcaggtgttccaatgacataaagtgttcctttgaatttatcttttaaatccattaaagcaagaccggaaagtacggagagagaaccgtgaaggttatgaccacagccatgtccgatttccggaagcgcatcgtattctgcaagaagtgcaacggacggaccatcgccgttatcaagtttggcacaataagcggtgtcatatccagcataaggataggtaacttcaaatccggcttcttttaaaatttctgccatttttcggctggattcaaattcctggtaaggaagttccggatgctcggctaaatctttgcttaaagcaattgccgtatcaagatgtttgttgacggcttctttaattttttcttttaattcactcatgggaatcaactccttcttctgtcacattctaaagtgtcaaaattcactttttgacacgcacatcataatagtaagatgattgcgtgtgttcgacgtgaatgaaaaacaattcacgtgattaaggtattgcgctatcgtattcgtgtattaaagtatacgttaattagcattatagcacattaaagtgataaaaacaagaagtaataaagaaggaatgaaaaaaatatgtataaattctaaactttttgaaatactaaggtttgtaacaaaaatcagttatgaaatcaggaggcagtaaaatggctaaaaattattcaaacaataatcagaacagtacaaataatgggatgaacgcaaacaatatgaaaaatggcggtatgcagaatcagacaaattcaacaaacagtaatacaaatgctgcacagtcaaattcacagacttcaaaaaatacacagaaaaattcaaatgcaaataacagtaaaaactgtacgcataataaaaatgcttccaatgagtatgaatattaaatcgtacagaaaataaaaaagttctaaaacaaggaacctgctgtgtgaaaggaattttgcatggcaggtttttgaatgcagataagcatttccgcgttttatcttttgtgcaggtacaaacgcaattacacttttgacatttccaacataagataaaagaaaaggaaaaataaaatggctggtatcgacacaatttcagcacagcaattggatgaatattaccgacaggatgtcgtatttattatagatttgagaagtccaaaggagtatctggaatgtcattattttggagcattgaatcttccttatgaagattttgatgaaatagagaatacaattttagagcacctgcccaaagagggactgatgatattgtactgtgacaggggaagtgcaagtctgatggcagccagagagctgatgaagaaaggatatcgggtaaaatctgtagtaggtggaatccattcatacagtggttctaacttgtatttttcgtcgatgcatagtaaaataaataaaaataaataagagcacattttatggaccggagagacagaacaaagaatcttgtctgtgagattctctgctattccggtccggctctaaaagtacataaaaaggagaaaaaagctatgaaatacatgtttgcatccgatattcacggttctgcttattactgtaaaaaaatgttagaagcttatgacaaagaaaaggcagaccgtctggttctgcttggcgatattctttaccatggcccgagaaatgatttaccgaaggactatgccccaaaggaagtcattgccctgctcaatgaaagaaaagatgatttatatgtagtaagaggaaactgcgatgcagaagtagaccagatggtattaaaattcccgattatggcagattattgcattatcatggatggagagcgtaccatttatgcaagtcatggacatatttataatgaaaataaccttccgcctttaaagaatggtgatattttcattcatggtcatacacacgtactgcgtgcggaaaagagagagacttatactattttaaatccaggttctgtttccattccaaaagaaggtaatattccaacttatgcagtgttagaaaacggtgtattttccattcgtggctttgaaggagaagttgtgaaggagattactttataatggataaatttgaattgattgcaccttgccattttggtcttgaagcggttatgaaacgtgaaatcttagacttaggatatgaaattataaaagtagaagatggaaaggttacattttcgggagatgcagaggcaatcgtgcgtgcaaacatgttccttagaacgacagagcgtattttgttgaaagtcggacagtttaaggcagtgacctttgaagaactgtttgaaaagacaaaagcacttccatgggagaattatataccggtggatggaaaattctggattaagaaagcaaattcagtgaaaagccagttattcagcccatctgatatccagtcgattatgaaaaaggcaatggtagaacgtttgaaatctgtgtaccatgtagaatggtttgaagaggacggcgcaagttatccggttcgtgtggcatttatgaaagatgaggttacgataggaatcgatacttcaggaatttccctgcataaacgtggatatcgtcaggcaatcagcaaagcaccgattacagagacattagcagcagccttaattaagctgacaccgtggagaaaagaccgcattttagtagacccattctgtggaagcggtacatttccgattgaggcagcgatgatggcggcaaatattgcgcccgggctcaatcgaaatttcttatgcgaggactggaaaaacctgatttcaagaaaatactggtatcaggtaaaagaagaagcacaggatatcatggatttaaatgtacagacggatattcaggggtatgaccttgatggaacgattgtaaaatatgcaagagaaaatgcggtacgtgcaggcgtagataaactgattcatttccaacaaagagatgtcaaagacttgagccatccaaaaaaatatggatttatcatcacgaatccgccttatggagaacgtcttgaagaaaaagaaaatcttccggcattgtatgaaacgattggagcacgttataaagaacttgattcctggtctatgtatctgattactgcttataaagatgcagagcgttatataggaagagaagcagataaaaaccgcaagatttataacggtatgatgaaaacctatttctatcagtttatgggaccgaagcctccaaaaccaaagaaaaccgtggaataagaggaaagaggataaaaaagagttatgaaacgaatgatttttgcaacaggcaatgaaaataagatgaaagaaatccgtgaaatcttaggtgcacttccgcttgaaatcctttctatgaaagaagcaggtgtttctgcagatattgtagaagatggaaagacatttgaggaaaacgcactgattaaggcaagagcaatctgtaaacttgcaggtgagatggtgcttgcagatgattccggacttgaaattgactatttgaataaagaaccgggcatttactcagccagatacatgggagaggatacgtcctatcatattaaaaataagagtctgattgaccgtttagaaggtgtgccggacgaaaagagaacagcaaggtttgtgtgcgcaattgcagcagtacttccggatggaaaagaattagtggtaagaggaacggtagagggcattattggatatgaagagaaaggtgaaaatggatttggatatgacccgattttttaccttccagaacgtggatgcacaacagcagaacttccgccggaagaaaagaacagcattagccacagaggaaatgcacttcgattgatgaaagaactgttagagagagaacgtttattataaagttcaaaaagagtggggtcaaaacttctttgaccccattacttctataatattatatacaaggaagggactcggtaaatgaagatacttattgtaagcgatacacatggccatgaagagaatttggagagagtggtagaaaaagtaggaaagattgactgtcttttgcatcttggagatgtagagggacaggaagattatattgaagcgttagtttcctgtccggtacatattgttgcgggaaacaatgacttcttttcagaactgccaagagagatagttgtcacaattggagattatcgtatcttgatgacacatggacattattatggtgtctctgtagaaaccagtatgctaaaagaggaagcacttgccagaggatgcaatgtggcattatatggtcatactcacagaccggacttggaaatcgagtcagagattacagttttaaatccgggaagtttatcctacccaagacagcatggaagaaaaccgagttatgcaattatggaaattgatgaaaagggaattgcgcattatgatatctactatttagaaagctgtaaataaaacagtgtaaattaaagcttttaaagggaaaatagcgggtattttatggaaagaaaaaaaaattaaaaaaatttaaaaaaaacgttgacatatagaaaaacctgtggtatattatatcttgtcacagggcaagagcaaaaaaaacctgagacaaaaggaaaaaaagaatactttcggggtgtggctcagcttggctagagcgcctggtttgggaccaggaggtcgcaggttcgaatcctgtcaccccgacttcctttaaaaaaggaaaacccatgcgggtgtagttcagtggtagaacaccagccttccaagctggatatgtgggttcgattcccatcacccgctttcagtatgcaatactgagtacgtgtttgtagctcagctggatagagcaacggccttctaagccgtgggtcgggggttcgaatcccttcaagcacgcttgtacagaaatgtacatataatggtgggtatagcgcagttggttagcgcgccagattgtggctctggaggccgagggttcgaatccctctatccaccttagccgtaaggcgttcttgggctatcgccaagcggtaaggcacagcactttgactgctgcattcgctggttcgaatccagctagcccagttcaaggtactaaattatggagcattagctcagtcggtagagcacttgacttttaatcaagttgtccggggttcgaatccccgatgcttcactggaacaagcaaaagcttgttcctatttttttacaattgcataggcgggcatggcggaattggcagacgcgctagatttaggttctagtgggagaccgtgcaggttcaagtcctgttgcccgcatgaaaaaaggctattgcatttaaaaatgtgatggtcttttttgtatctaaaataaaaatgtatagtttgttcaaataaaaaacaggacttattcatttcaaatttgctaagtttcgtataagataataaagagttatattacttagatgacagagggaatgataaatatgaaaacttacgatttaattttatttgccggacagtcaaacatggcaggaagaggaatttcaacagaaaaatggaacgagccagcacctttactcttagatggtgctggaatggagtatcgggcagtcagcgacccagagcatatacataaaatagaagagccatttggtgtgaatgaaaataatccaaatggtatctatgaaccaggaatgaaaacaggttctatggtgacagcttttgtaaatgcatattataaagaaacaaaagttccagtattggcagtatccgcaagtaaaggtggttcagctatctgtgaatggcagggaaatgaggattatttatcagatgccatcgaaagattggaaaaagcagttttgtatgcaaaaaagaatcaaatagaaattcggcataaatatgtagcttggtgtcagggagaaaccgatggagatagaggtactttagcagacgattacaaaaagaaatttaaaaatatgcttgaaagactaagaaaagcgggaattgagaaatgttttttggttacaatcggggaatacaatggtaaagatggatatgaagaggcatatagaaaaattcgccatacccagctggaactggcagagaaagtggaagatatcatactggtatgtgatgaatttcatacgatgaaagcacgtgaactcatgaaagacagctatcattattttcagacagcatataatgaggttggaaaagtggcaggagaaaatgcaggcagaatctccacacaagattcaagatttttcaaacaaaaataaattgtattttcaattatcgaatgctatacttcatttcagaaaaataaatatgcgaatagaaattgaaactattatttttggaggagtttgaatcatgagaatttatgtaaatgcaaatgcaggtcgtgatggaaatggtactgcaaacatgccgtttcgtcatatcaatgatgcagcaaaagtagcaaaggcaggagatgaggttttagtttctcctggtgtttatcgtgaatatgttaacccaattcatgcaggagaagaggatgcacgtatttcttatagaagcacccagccgcttggggctgttattactggtgcagagcaggtaaagagctggcagaagtatgaaggaaatgtatgggtatgccgaattgcaaacagcatttttggaaattataatccatatactacggttgtttatggtgactggtactttgcaaaggcagacaagcacacaggctgtgtttatttaaatgataaagcactttatgaggcagtttctttagaagagtgcatgaaaggtgaagtgtatgagtgcagctgggtaccggaagattctatttataaatggtacaccgagcaggatgaagaaaaagatgaaactattatctatgcaaacttccagggtaaaaatccgaatgaagaaaatgtagaaatcaacgtaagacgtgagtgctttatgccggaaaaaaccggggtaaactatattacagtaagcggatttaatattaataaagcagcaacaacatgggctcctccagcagcatttcaggatggtatgattggaccacactggagcaagggctggattatcgaggactgtgatatttcaaacagtaaatgtgccggaatttccgtaggaaaatatttagaccctgaaaatgaccattattttacttataaatatgtaaagagtccgactcagatggaacgtgatgcagtctgcagaggacagtatcatggctggttaaaggaaaacatcggtggacatattattcgccgtaataatattcatcactgcgaacagggcggtattatcggtcgtatgggcggtgtattcagtgtcatcgaggacaaccatattcatcatatcaataacatgatggaacagggtggagctgaaattgcgggcattaagatgcacgctgcaatcgacgtaacaatgcgccgtaatcacattcatcattgtacaatgggtatctggtgtgactgggaagctcagggtacaagactgactcagaacctgttacatgacaaccagaaaccggcttatgcaaagagcttaaaaggcggtatgatgtctcaggatatctttgttgaagtaggacatggtccgactttgattgataataacgtaatgctttccgatgcaagtttaagatttgcaacagagggtgttgcactggtacataacttaatctgtggtgcgctgacttgcgttggtgatggaaccggatggcgttatacgccatatcatatgccacaccgcacagaagtaatgggatttatgaccattcttcatggggatgacagaatttacaacaatatctttgttcagaaatggccgtcagaagatgtgattattccacacgattctgatgaaggatttgattctgaaaatagaaaagcaggaacctggatgtttgatgaatatccgacttatgacgaatggatttctcagtttgatttcacaaaaccggttgatatgaagaaattagagccggtacactttgggcatcttccggtatggattgagggaaatgtatacttaaatggcgcagaagcgtgcaaaaatgaagtgaatggactggttatttcagataaagaagcaaaagtggatcttgtagaaaaagagggaagctattacttagatacgaatgtatatgatttagtcggtgagtttaaagaccgcatgattcattccgatatacttggaaaagcatttgagccggaacagagatttgaaaatccggatggaacagccattcagtttgataaagactattttggcggacaccgtggcatggatgtcattcctggaccatttgcacaggcagaagatgcgaagaaagtgttgttctaatttaaaaaagtgtattcttaaataattcaatagaaaagatgaggtgttttttgaaaaagcacttcatctttttcatttctcctcttgccaaatgcacaccatgagtatataataaaacaaaaatgtgtgctttttattccaaaaatcaaatagatttgtgtgcaatgtgtaaaatttagagcaccggaggcaaaatttatggcgggaacgattcagcagattgcggaactggccggagtttcaaggggaactgtggacagggcattgaataacagaggaagaattaatccggaagttgcaaagcagatttggcagattgcagacgaaatcggatatgttccgaaacatcagagaaaaaaagaacaggaacaaaagaaaattgaggagacgtatcggattggtgtggtaacacagctttccaattctccatttatgattcaggtaaataagggaatttatgatgcagcagaacggcttttggagacaggagttcaggtgattgtaaaggaaaatccttctgtcgacgaagaagcacagttgaaatccattctggaactggaagaagcagggattcaggcactggcaatcatgccggtagactgtgatcggattcgggaaaagttaaatgacttaatcgaagaaaaacaaattccggttgtggcatttaataccgatatcattggaacaaaacggaattgttttgtgggactggataactggaagagtgggcagaccgcagcgggactgatggggcttatgatgcatggaaagggaaaagttcttggaattaccggatatttttcgaaccgtgccggcagtagaagaattgatggatttatagaggaaaccagaaaacagtttccggagatgaacctgattggcgtgcaaagcagtcaggacgatgcaaaagaagtagagcagattattgtaaatgcaatgaagatattcccagatttgaagggaatctttgtggcatccggcggacaggaaggtgttaaagctgcatttgatgaattgaatctggaaaaacgcccttatgtgattatctatgatgtgacaccggaaaatgtaaaagcgttgaatgaagataccgtggatttcctgattgaccaggaaggatacgagcagggttatcgggcagtatctatcttagaagaatgtctgaaacacggcagtctgccggaggaagagtatcagtacacggaaatcagtattaaaacaaaatataatgtgcaataaagaaaatagaaattagcaaagaactctttttgattcataaaaaagggttctttttttgttgtgaacaaaaaacacgcataaaagcacacaagaaactagtaaaattgttataaaatcgagcctttagattgtgcagaatatcgaaagtgtgcaaaaacaaaaaaagcacttgtaaaatgcgtgtgcaagtgctactataaagccagaaagagaacacgtgaagcacacaaacgaaaataaagcacgcacacacatagtaaaaatagtaaaaaaggaatttgggaggacacttttatgaagtatgtagaatttgatgaaacaagaccaatggatttggttttactgggacgtgtcgcaattgattttaatccagcttataacgaccaagtgaaagaagaatttaaaccactgaaaaaagttcatatgtttgaaaaatttgtaggtggttctcctgcaaacatcgcagtcggagttacaagacatggactgaaagcaggattttttgcaaaggtatcagatgaccagttcggagaattcgtagtggactacttcaatgagcagggaattgatacttcccacatttcaaaatgtacaaatggagaaaagttaggactgacctttacagaaatgctttctccaaaggaaagcagtatcctgatgtatcgaaactgtattgcagacttacagttaagcgtagatgacattgatgaagaatacatcaaacagacaaaagcaattttaatttccggaacagcacttgcagaaagtccttcaagagaggcagcaatcaaagcagtaatgctggcaaagaaaaacaatacaaaagttatttttgatatcgattacagagaatataactggaagaacagtgatgagatttccatttactattccatcgttgcaaaagaagcagacatcatcatgggctcaagagaagaatttgatttaactgagaaactgattcagccaggtatgagtgatgaagaatccgcagctttgtggcagggttacaatgcaaaaatcgtagtaatcaaacatggtatgaaaggttctaccgcttatacatgtgacggacagaaattttccattaaaccattcccggtacaggcaagaaaaggatttggcggcggagacggatatggttctggattcttatatggattatatcagggatggcaggttatcgattgtctggaatttggttcagcagaagcatccatgatggtaagaagcaacaactgttccgattcccttccgggaccagatgcagtacacgcatttattaaagaagaaaaagaacagtacggcgaaatgattgcgagagtataaaaaagacgaggcaaaggaaggagaatacaaaatggcagagacaacaagaatgacagttgcacaggcaattgtaaaatttttagataatcaatatgtatccatggatggagtagaaacaaagtttgtagaaggatttttcacaatctttggacatggtattgcagttggacttggtgaagcgctggataccaacccgggacagttaagagtcatgcagggcagaaatgaacagggtatgtgccatgtggcgactgcatttgcgaaacagaataacagaaaaaccattattccatgtgcttcttctgtaggacctggagcagcaaatatggtaaccgcatgtgcaaccgcaaccgtaaacaatattccactgttagtatttccggcagatacttttgcttccagacagccagacccggtacttcagcagttagagcagagcaacagccttgcaactactacaaatgatgcatttaaaccggtttgcaaatattgggacagaattacacgtccggaacagttaatgacagctttaatcagtgcaatgagagtactgacagacccgacagataccggtgcctgctgtatcgcacttccgcaggatgtagaaggtgaatcttatgattatccgaattacttctttaagaaacgtgtacacagaatcacaagaccggttgccgtagaagaagagttagaagatcttgtggaaattatttctcaggcaaagaaaccacttgttattgtaggtggcggtgtaaaatattctgaagccggagaaaccgttgaaaacttctgtgaagaattccatattccgtttggtgagagccaggccggaaagagtgcctgcaaatccagtcacccatactgccttggcggaatcggtgtaacaggaacactggcatccaatgtgattgcaaaagatgcagatgtagttatcgcaattggttccagactgtctgactttacaacaagctcaaaacatctttttcagaatgcagatgtaaaatttgttacaatcaataacaaccgttatcatgcatacaagatggacgctgtaaaggcggtgggcgatgcaaaagcaacggtagaggcacttgccgaaaaactgcgtgcaaaaggttatgtttcaggttataatggagaaatagaagcagcaaaagctgcatgggacaaagagtgggatcgccttgcaggaatcgagtatacaggagatgactttgaaccgattatcaaggcaagagacccgagaacagttccggaatttgtaaaattaacgaacggaaaaattacacagactgccgcacttgcagcaatcaataaaacaattgataaagatgcaaccattatcacagcaggaggttctcttccaagttgtatgcagcgtatgtggagaacagacaagagaggcggatatcatgcagaatatggttattcctgcatgggatacgaagtggcagcaactcttggtgtaaaattcgcagagccggataatgaagtttactgtgttgtcggagactccagtttccagatgcttcacagcgaaatcatgacgattatgcaggagagaaagaaagtaaatattttaatcttcgataactgtggatttggatgcatcaacaatctggaaatgaaccatggtatcggaagcatcgcaacagaattccgttacacagatggaaagaaaccgacaggagatttaattccggtagactacgcaaagattggcgaaggatacggattaaaaacttatacatgcaaaacaatcgcagaacttgtggcagcattaaaggacgcaaagaaacaagaagttgcctgcctgtttgacctgaaagtaattccaaagacaatgacagacggatatgaatcctggtggaacgtaggaatcgcaacaacttctgaaaaagaaagcgtaagaaaagcttgcgaaggtgtaatggaaggacgtagagaatccagagcttactaagatttcaggagtcatgtacgcttgaacaaaaaagtttaagcgtacagaagtacaattaagtacaattaggaggtaaagacaatgggtaaagtatttggctatccagaatttgacgaaaacggcgagaaaattttaacaacttatgacaatgactataaagaaatgatgatggacattcgtgtgtatcgcatgaaagccggtcagacaagaaccttcttaagaacaggtgaggagactgcagttctgcttctctctggaaaaatcacttatgaatgggaaggcaatacagaaacagtaagcagaaaagatgtgtttaccgaaggtccttggtgtgttcatgtatgtaccggaaaagaaataaaagtaacagcagagaccgatgcagaaattcttgtacagtgcacgaaaaatgatgcagactttgcaggaaaattatataaaccggaggatgctccatggggttattcctgtgttggcaaatttggaaatgttgcaaagagaagagttaataccattttagaccatgatattgctccgtattccaatatggtactcggagaagtattaaatgacaaaggaaactggtccggatatcttccacacagacatccacagccggaaacttattatttcaaatttgaccgaccggaaggatttggtgcaagtttcgtaggagaccaggtatttaagagcacagacggaagcttttccgcaattccgggaggagagttacatcctcaggcagttgcgccgggattccagatgtatacttgttggatgattcgccacattgacggaaatccatggttacagacagatcgttgtgaagatgaaagatatacatggctgcatgatgccgaaatctaagaatgaataatagatttatttgataatttaagaaaaaaaagaacgttaaaataaagtaaaggaaaatcaagaaactaagtttagaaaggatgcgtgttattatggcaagagaatttatcgtaccgggacagattatcacaggttcaggggctttaacaatggcggaggaaactttaaaaggacttgggaaaaaagctcttatcgtaacagataaagtaatgattcagttaggaaactgtgcaaaagtagaaacagctttaaaaaatcagggaatcgactatgcaatttattctgaaatcgttggtgagccaacggatactatgattgaaaatggtctgaaagtatacaaagaaaatggatgtgatttcttagttgcattaggcggaggaagtccaatcgactctatgaaagctattggttctttagttgtaaatggtggaaatatctccgattacatgggaaaagtaattgatgtagaaatgccgccgcttgttgcaattccaacaacagcaggtaccggttctgaagcaactcagtttacgattatcacagataccaaaaaagatatcaaaatgctcttaaaaggtaaagtattaatgccaaaactggcaatcattgaccctcagtttacaatgacagcaccgcctaaaattacagcagctaccggtcttgatgcactctgtcatgcagtagaagcttacacatcaagaaaagcacagacactttctgacagctttgcaatgtcagctgtaaaacgaattttcaaatcccttccggttgcatttaaagatggaaaaaatgaagaagcacgtatccagatgtctgttgctgcattagaagctggtatcgcatttaacaacgcatctgttaccattattcatggaatgagtcgtccaatcggtgcactgttccatgtagcacatggtctttctaacgcaatgctgatgaaagaatgtttaggctttgcgttagaaggtgcttatgacagatttgcagaccttggtcgtgcaatcggtgttgcagatgcaacagatgaagacaaagcagcagcggaaaaattcctttcagcagtcgaaggaattgtaaaagaattagagacaccaactcttgcagagtttggaattgataaagaagagttctttaaagtaattgataaaatggcttacgacgctatggatagtggaagcccacagaacactatgcgtgaagtaagcgaagaacaggtaaaacagatttacagaaatctctggtaatcgtctatgaaaaaacggcagataggaaagctgggactggttctgcttgcaggaatccttatggcgggatgtggaaagacaaaagaagaagcaaaagcgccaaagtataccattggagttgtgaccaagtcaaaaagcagtgaatattggatgtctgtctgttcgggaatggaagatgccgcagaaaaagaaaatgcagaggttgtgattttgtctccggattcggagacagaccagaaaacacagaaaaaaatgataaaggatttactgaaaatgccgattgatgcactggcagtgtccactgtgaattcttacgacaatgcagattatattgagctggcgaaaaacaggggaatcgaagtgtatgcttacgatacccctgtttctgacgttgttttaccttacgttggaatcgatgacgagaaggtaggatatgaacttggacaggcaatggcaaaaaaattaaatggaacaggaaaggtggcagtcatagcaggaagtaccacacaggcctgtcatgaaaagcgtattttgggctttaagcgttgtatggaagaataccctgatattcagatagaagttgtaaaaaccggatacagcaatcttttggtttcggagcaggatatgaaagaattattagaagagtatccggatttggatggaatcatgacaacaagtgcggtgacggcacttggagtggcagaggcaacgaaggaaagcggaattttggttgtcacagtggatgcacaggaagattccattgaaggagtgaaagacggaaagtttcttgcggtaggcgcacagtccggatatgatatcggttatgagacaattgaatatatgatagaaagtttggaaaaaaacgaaataccaggtgaaaaaatattggacacaaaaatattgacgatagacaatatagatgagtactcacctaaaaaaaagacacaaaatataaaaaaatcgcaatcagaaagttaaaagagcaaagtttcctaaaaaaggggactatttttaggaaagaagagaggcggatataaaaatagcacaataaaacccaaaatttctaagactgggattttccctgcaaaacggtaaaatagaatcatcagatagagaaaatgcgaaagcaaaaaagcatcttatgatttgaacgcagataagcattcctctgcttcaagtgtgcggagcactaagcggtgggtaagggggatgcttctgtcagtgggagtcaaaagctcccattgacagattgcgaagcgactgcgttcatgagcaagcagcgaagcggattgcgaatgtccgctttactacgaaaggtattctcgaaaaagaaaggcagggaaatgaaatggcaaaagaaatgacacggacgaaatcagtcacagcagatgactggtcggcaaggtcgaaaatgatgaccgtgatgaccgcacagaatcagaaacttggatggggaacaagagttgcctacgcaagtggtgacgtagcctgtaatgttgtatttggaatggttggtaccttattaaccttattctatacggattacgcaggaatcaatcctggtacggttggtttgatgatgctcttatcaagattatttgatggtgtgtcagacttgattatgggaattattgtagaaaaaacaaattcaaaatggggaaaatcaagaccatggattttatggatgagtgtaccatttgctttatccgcagtactgttatttacggtaccgcacaccaccccgatgttacagtttttatatctgtttgtaacgtataacttctgtactacagtttgttataccgcaatcaaccttccttacggaagtctttcagcaatgatgacaagagtttccggagaaagagatatgcttagtgtggttcgtatgggattatctccaattggaaaaatcgttgcagcaacctttactcttccgattgtaaaaatgtttggagatgaccaggcggcatgggtaaaaacaatgagtatctgggctgtacttgctttaatcttattattaatctgtttctttaactgtaaagaaactgtatacattgaagcaaaagaaaaagcagaaaaagtaccgcttggaaagtccttgaaagcattatttacgaatcagtatttctgggcagttttagttttgtggatggttcagagtgtttcctttagtatttcaggaacaatcttaccgtattattgcaaatacatttttggaaatgacacatggatgtacagtgcattattcttgacagaaacattaacactggtagcaggaattttcctctgtgcaccacttatcaaaagatttggcaagagaaacattgcacttgcaggttctgcaatcgcattagtcggacagttattattcttcctgaatccatacagcttttcttggatggttatgagttgtgtggcacgtgcaattggtcttgcaccgctgaatgcagttgtatttggaatggttggagatgttgtggaatatggacagtggaaaacacatgtaagacaggaaagccttatttttgcaggtggttctattggaacaaaggttggagcaggtcttgcatccgcagctatgactggattgttaacttttgcaggatatgttacttcttcttcaggagttgcaacacagtctcaggaaactttaaatatgattattaacatttataaatttggtccaattattatcgcactgcttgcatttgttacactggcactctacaagctggacaaaatgtatccggatattatgaaagagctgacagaacgtgaggcaagaggcgaactttaatgaagcttaaatgagtgaaagaaaaaaggtatcggaagttttccgatacctttttgtgttagaaagaacaaagcacaacttgcgggcattttgtgctataatcaaatcaaaagtaaaggattttaatctatgaaacagagtatccgcaaaaaagtactgctggcaatcttgctggtgacgattcttacaagctgttgtattacggtcgtattttatttccgcagtgcatcaatgattgagaaaaattatacagaaaccgtctactcgagagtccggcagactatggaaagttttgacaattccatgaaggaattatattataaaaatattgagatggccggaaaagaagagctgcaaagagaaattgagcaatatcgggaaagcaacaatgcagatgaattggagagtcttgcagaaattttgcgtgcctgcaaaaaaaatgaggatcgtctcagttcaattgatttgattttacccaaagaacagattgcggtgacttctgaagattttccggtttataaaagggaaattccaaaagaagagattcagaccataaaagagatggaagaaaaaacggcacgaccggttatggtaaaaaacagcgtgcatgagaaccggactcaggttacagagattcagccaatctacgatgaagaacaaaatattcttgcgtatttattattaaacgtagaagaaagaactctttattatcaatacatagacccgatttatgatgaaaatatgaaccaggctttggtttatgatgaaaatgaagtagttgtcacagggatgaattccaaagaagccggaaaagcgtgtgcagaagagatgtgtctgaaacagaatgggatttttcaaaaagaaaaaggagtaattgtgattggctataaaggcgcattttccggctgtcagctttctattgcggtgcaaaggaatgcaattttgcgccaactccgtcagatgcagatttttttgattgtaattgtgctggtatttttatttgtggcaattgtgcttgcaggcagtttgacgcgtgcaatttaccgtccgataaaaaagctgaccgatacggtggaacaggttggagagggagatttgagtcttcgtgcggaggtagaaaccggagatgaaatcggaatactgtgtcgggaatttaatgtgatgcttgatgatattcaggagttaattcaaaaagtaatcgaagaagaacgattaaaaaaagatgcagaattagaagcacttcagtatcagattaccccgcattttatgtataatactttaaattcgattaaatttgcggcgttgatccgtggggaaaaggagctaggtggtctgataggagattttgtggagctgcttcaagcgactatcagcaagaaaggtacttttttaacggtagcagatgaatttcatattttaaataattatgtgcatctgcaggaatttcggtatcagggaagttttcgtgtgcgttatgagatggaggaaggcgccggaggttgttatattccgaggttgattttacagccccttgtggaaaatgcaattcttcatgggattgacatgaaagaaaaaaatggagagattattttaagagcaaaattagagcaggatcgattacggctgtttgtcattgataatggcagaggcatgacaaaagaacagattgatacgctattgcacagcaaaactaaaaagaccaatggtttaagtgcaatcggagttccaaatattaaagagagactggaactttactatggagataagggaggaatggtctatcaaagcagtgaaaatggaacgactgttgagatttttctccctgcaaaaaaagaattatgaataagtccccgtccactgcttaatgattttggtgattgaagcagggtacttgacttatttgattcaactaaaaacagactaaaatacaggtggtgaagtgatgtttcagacattattagtggatgatgattttcttgtaagaagttatttaaaaacacttgattcatgggaaaaagagggatatgaagttgtacgtgatgtacaggatggggaagaagcccttgaagtgatgaatcaggaaaaaattgatattgttgtgacagatatttcaatgccgcttatggatggaattgaattaattaaggctgtaaaaaagaactggccggaagtttctgtgattgtgcttagctgtcatgatgattttgaatatgtaaaagaagcaatgcggcttggtgcagatgaatatattttgaaaaacaccttggatgaaaattcacttttagaagtattagagaaagcgaaggctcaaatagaggcaaaaaaggcaaagactacacaggagaaacatacaaaaaaactgattcagatgggcagtcatacattaaaatatcatttctttaatggagttctttctcaaattttagagggagaagtgcgggaacagaaacgtctggaagcgcagatagcaggcagttataaaaacagtgcggtgattgcaatgtttatgcatgactggaatcgtcagaacagggagtggacaccactggaagcggaacagtattcattggaatttcggacgggaatcgagagtgaaatcgaagctgtgttaggcgaagaaaatgaattaaaagaaattatctatctgggagccggaattttctgttgttttctggatttatcagaaatgagaagagactctttgatgcgccagagactgacagatgttgccggagcctgttttcgattttgtaaaaaagagtcgtattcctttggaatcagtgtaagcagtatctgtattggagtacaggatggacttcgtcaggcatatcagcaggcaagacagatgatgaaatatggattttatgacagagacagcattttgtactatgactgtcaaaaagaagtttcaagagagcttccaaagagtgcagaaaagctgattcatcaggttcagaatcaaacagagaatacagaagaagaactggagcaagaggctgtgacacttatttctgaggcaaaacagaagatgacggatggcagaattttagttcagtggcttcacaaattggatgaaagtgcatacattgagcgaagtgcacaggtgtatacggagattgcttcgattgaacaatttaaaatggctttagaagaaagcgtgcaggaagtctgtaagcatagcgaagaggagattccagaaggggtttctcatacgataaaagtggtgctcttgtatctgcatcagcattataaagaacaaatcagcctacaggatgtggcagaagaagcaggagtgaattcggcatatttaagttatttatttaaacaggaaatgggaatcggatttgccaattatctgcaggaatgtcggatgcgctgtgctgaaaaaatgctctgtgacacgaacttaaaaatcaaagaggttgcagaggcagcaggatttaatgattatcattatttttctaagatttttaagaaataccaccactgcagcccggcggattatcgcaaaaagcagtaaaaaaaagagatgcacttgtgttgttcaaagtgcatctctttttggttttcgttaccgagtgtacggtatcattgactttcagataaataacgcagcagatggaaatttatccaagttattttattttcccaagatttcttttaatgcctgtaatacttcatccacatctttttcatttgcactttctcccatatgcccgatacggattaattttccaccaaagcatccaaaagagccggcaagcagaatattataatcgtttctcatttttgagagtatttctttatctgtaaaaccttccggaacttcaaacgtagtaacggtattagaataaccggagtgtggatataaggtcagtcccatttcttttaaagtggttctggtcttttcggctacttttgcatgacgttttaaatgctccggatcatttttgatattttcaagtgcctgacgcagaccatagatgtcgcttgcaggcatggtataagggaaccacttttcttcatagtaatgttcaaatacttttaagtttgcatagaaagaagcaattggtgtcttacgctgattcatgacatcttttgcatcctggctgatggtaacaatagtcagtcccggaggtgcggaaattgctttctgagaaccaccacataaaaggtcaatccggtaatcatcggctcttacttcttctccgaacatcgcagatacggaatcgacaacggtgaggattccataggattttaataatgggcagattttagaaatatcgtttaacataccgcttggtgtatcgcagtgcacgactgtggcatatttaaaatcgtgctgttcttttaagtattcggcaagtttttcagggtcaaccggcttgtcataatctacggtatagagagttggaatgccgccatacatggttacgaaatctttaaaagattcaccgtaaagtccattatcaaggacaaggacacggtcacctggttcggtgatagaagcacaggcagcttcaagaccgaggattccctctccatcaagaattaaagtttcatttttggtgtgtaagagttcacttgccaaaaggcaggtctctttgtagtattcacagaaatcggcatctaaatccggattttgaaattccaggcttcttgccatgcgtacattttcccgtacctgagtcggacctggggtcatcattttatacatctgtttacgctcctttataaattattttttgagttttttattttacgagtttctgaagacgtccgattaccagtaaaacgataacggctgcaacgccaatctgaaccagatttcccggaatagaagcaacaggagcagcccagtttccatagataaagccttcggcgatatagtaacctacgactttaatcacacaggcaactgcgattgcaaggacattccatccaaagccttttcttttttcggtaatggcgccgactgcaaatcccatcagtcctacaattacaagagtaaatggtgcccatgcagtccatccggacagtaaatcaaataatcccattccgacaccgcctgcgattgcaccggttttcttgccaaataaaattgcaccgatgaaaagcggaacatttccaagatggattaaaccgccgtttgcagcgattggaagtttgatgtttacaaatgcagtaaatacataagtcaaagcgataaacattgctgtaattgtaataaagcgaatctgtgaactggttgtctgtttttcggcaaccggaatggctgtattacttttttcaatcattaaatttttcctctctttctctctgtcggtactcgcaaaatcaaaaacaagaagattctgagagtacacacgattcatcttatcttgagttttaagtatcataacgaaaaacaggcttgcttaaaatagccagttttctaaagttttaccagtccagttgcgtttggaacatttgccaagaggaatggaatgtggtacaataggagaaaattttgcgtgccccagaacgtagagaagaaatgaggaaaagaaaaaaatgggtgtaacaatcaggcagattgccgaggcagcaggggtgtcaagaggaacggttgacagggcgttaaataacagagggcggattcgtccggaggtggcagagcggattcaaaaaattgcagaggaaatgggatatcgcccgaaccagcttgggcgggcactttcgatgagtaaaaataatattaaaattggagtgattgttcaggcatgtgagaccccatttatgaatgatgtgttagaaggtgtaaaaaaagcgaaagaagaagtagacaaccttggaggaacggtgattgtctgcaagattccacatatcagtgcttcggacacaattgaagcaatggaagagatgcgaaaggacggagtcagcgcaattgcaatggttccatcggatgaagaggccgtcaaagaaaaaattcgtgaatttacaggagtctatcagattccgatagtgacatttaactcagatgtgccggataccggaagactctgttttgtcgggcaaaatggtattcagtgtggaaaggcagcagcaggtctgatgggagaattggtaaacggaacgggaaaaattgccattatttccggatatcggacgaacccttctcttagagaacgtgtggatgggtttacaacacagataagagaaaagtatccagatgtggagttggtcggaccagaatattgttttgaagaaaatgaaaaagcagagaaaattacagaggaaatattaaaagaaaatccggatttgaaagcaatttatatgacctcccatggagaatcgggtgtgtgtatggcattaaaaaagaaaggcatggcaggaaagataaaaatgatagccaatgattttatgggggaaaactacaggctcatgagagaaggttatattcattttttgattggacaggacgcttcgattcagggttacgaaccggttatgattttatttcgtctgctgtttcatgcagaagaaccggaaaaagaattaatttatacagaaatttatatccgaaatgaatatacgattccggaataaaaataaagtagaataaaaacaggaggattattatgagtatcaaagaacagattcatgatttatcagatgaaatgataacaaatattggcagactggttgcgattgattcccagcttggaatgcctggagagggaaaaccgtttggggaaggaccggcagaggcactgaaagaaggactgaaaattgcagaagaacttggatttaagaccgtaaacttagataattattgtggttacgctgaaatgggagagggagaagagattgtcggaattgccggacatcttgatatcgtgccggttggcggagactggacttatgacccatttaagctcacaagagagggcgattatatctatggacgtggaacgacagatgataaaggtccagtcatcgaggcactttatgcgatgaaacttctgcgtgattcgggtgtgaaactaaataagagagtgcgtcttattatgggatgtaacgaagagaccggttcaaaatgcatggaacattataatgaagtcgaagaggagttatcctgtggatttacgccggatgcaaatttcccatgtattcatggtgaaaaaggtcatatgtccatggtggcatattcaaaaaatacaaaaattatttctatgaatggcggatttgtttcaaatgcagtctgcgatgcgtgtacaactgtgattccggcagaagcgggattaaaagaaaaattagaagaaattttagcaaagacaaagcttcaggaatatcaagtgaaagaagaaaatggaacaatccgtatttatgcaaaaggagttccggcgcatgcaagcacaccgacacttggagtgaatgcagcaggagcaatctttgagagtcttgaaaaagcaggatttgaagatgattttgtgaaattttataacaatcatatcggaatatcctgtgatggatctggaatcggattaaaatttgaggatgaatacggtgatttgactttatgtaatggaattgtcaaaacagaaaatggtgtcatttcctgtacgattgatattcgagttccggtgaccttaaaagcagaggatgtgcgtaagatgtgcgaaggaaaacttgaagatgaaaacggacgaattgaaattcttgaaatcggcgacccgttgttcttcccaagggagtctccgcttgtcaatgcgctctataaagcgtatgtggatgtgacaggtgataccgagaatgaaccgatggtaatcggtggcggaacttatgcaaaatcccttaaaaatattattgcatttggaccggagaaactgggaattgattatcggattcacagtgcagatgagtatatgctggtttcgggtatggaagaagcggtgctgatttatatggaagcaattaaaaatcttttggagatttgacagaaaagagagacgtaatatttatgagagaatcggatgccggatggacattatgaagatattattccgcattattatgtgttgtaaaaacaggagagaaaaacaatggtaaaatcaattatgagagatatctttttcttaaatcaaaaatcagagccggcaatgaaagaagacattcagacagcagtggatttgctggatacattaaaagcccatgaggatggctgtgttggcatggcagcaaatatgattggggtaaagaagtgcattattgcagtgaatatgggatttttaaatgtggcaatgcttaatccgaaaatcgtgaaaaaatctggaaaatatgagactgaagaaggctgtctgtcccttgaaggggtacgaaaatgtaccagatatcaggagattgaagttgagtatgaggatatgaattttaagaaacagaggcagaaatattctggatggacagcacagattattcagcatgaatgtgaccatttggaagggattattatttaaccaaatcaagcaagtagcgaagcggattgcgaatatccacttgactcaggtggtagcagggaaaaagttttattcctgctacctattgcattataaaaatgattttaacacttctaacactccactttcccagtaaggtgcacaggttgatttcgccgcttcgattacctctggacgggcattggaaacagcatagctggttccggcattttttaacatttcaatgtcgttgagattatcaccaaagcagcagatttcatcagcattcagttgatatttttccattaaaaaggagatagcagtccatttgcttactccaagcgcattgcagtccacccattcttttccggcaactgcaagctgagctttttccttccaggaaggaatgaaaagaggagtacacatttcttcacaggcagttggatgataaatggtaaatttaatgatatcctttgattctaatttagataagtcatcgatttctttcatttcaaacccataagaatctcttaaccagtggaacatctggctgcctccatcttctgcaaaacagtaatccggtgtagcggcaaaacagtcacaggatggaagtttttctttaaccatctgatacatatttttccaaagttcatctgacattggataagtttttaagatttcatttggggtgcggacgacggttccgccatctgaaatatataacagtttgtctttgattgaggcaaagagtttcttttcacttgaaaactgacgaccggagcagacaacaaacagaattcctttctgggttagctgttcaatcacggtcatgtactccggattaatcatgagagttccgtcttttactaaagttccatcaatatcagttgcaattaattttatcataagaaaaaatcctccaggaaataagataaagctatacttaaagataattataagtgagattttattttgatgcaagaaaaagggtggttcggttttggtaaaatttatagtgaatctgtacaaaatccattgataaaaattataatttttgtcaatggattttttttgaacggagatatatacttaacttacaattaagatataaacataagtgaaaagtaaaacttgatgcaagataaaattaaggagaaaattacgacatgaaattaacaatggatgggatcaaaaatcgtgaagcatgggagaaagcaggaattcagcttccgggatacgatgtgaaagagatttcggaaaaagcaaaaaaagaaccaagatgggtacactttggaatcggaaatattttccgtgtatttatcggtggaattgcagatggtttattagaagaaggtgcattagactgtggacttacctgcgtagaaacatttgattatgatgtagtggataagatttatactccttatgataatctgggcttaagcgttattcttcatggagacggaagtcgtgaatataaagtgctgggttctctggcagaggcagtaaaagcgcagtcatctaatgagacacagtggaaccgtttaaaagaaatttttacaagtaagtcgttacagatggtttcttttacaattacagaaaaaggatatgcattacagaaagcagatggcacatggttcccattcgtacaggctgatattgaaaatggtccggataaagcgacaggagcaatggcagtagtagtggcaatgttgtatgaaagatacaaggcaggaaaatacccattggctttggtttccatggataactgttctaaaaatggtgcaaaacttcgtgaatctgtactgactatgacagaagaatggaaaaaagcaggatttgtagaggaaggatttgtttcttatgtcagtgatgaaaaagtagttgctttcccatggactatgattgataaaattactcctcgtccgagtgaaaaaattgcagatgatttggaagaacttggcattgaagaaatgcagccggttattacaagtaaaaaaacttatattgcaccgtttgtaaatgcggaaaaaccacagtatctggttattgaagacaatttcccgaatggtcgtccggcactggagaaaggctttggtgtttatatggctgacagaaatactgttaatttatcagaacgtatgaaagtaactgtatgcttaaatccggtacattccgctacaggacctcttggagtcgtacagggatatgacttatttgcccatatgttaaatacaaatgaagacatgatgaaaatggcacgtatggttgcttatgatgaaggacttccggttgtcccaaatcctggaattctctctccacaggcgtttgtagatgaattattcaatgaccgtttcccgaatgaatatttaggggacaccaatatgcgtctctctgttgacgtctctcagatggtgggaatccgttttggagaaaccatcaaagcttatgttgaaaaatttggagatgcaaaaaaactgacagcgattccactcggaattgccggatggcttcgttacatgcttggagtggatgatgaaggagaaaaatatgaattagctccggacccaatgaatgaagaaattcaggaacagttaaaagagattgtaatcggaaaaccggagacatttacagaccagttaaaaccgattctttctaacgagcgtctgttctttgttgatttgtatacaacaggtgtggcagaaaagatagaagaaatgtttagagaaatgattgcaggaaaaggagcagtaagagcaaccattcataaatatgtaaatcagtaatagaaaataatagaaagaatcgattcaaaaggtgattctccagaaggtggagagtcaccttttttgtacagaaagatttactcagcatacactataaaaaatggaaaagaaaaaagccaaatggaaaatcaaaaactggaaaatctattaaatctggcattgaatgccacaccggaggaattggaaaaatcagaaaatttatcggttggttatgaaacagaacaaggaaaatgggaggtaattgtaaaatattctggagaaccggagatttttgaaaatccggaaatccagaccgtaaggcttttgggaggttttgcaattttaacgctttcacaaaatcaaatagagagattggcaaatgacgcaggggttgaatttatagaaaaacccaagcgtttattttttgccgtaaatgagggacgatcggcttcttgtatcaattcagtgcaggatgagtcttttttgcagggaaattccctgtttggagagggagttctagttggatgtgtggattcgggaattgattacagtcatccagatttttgtaatgaagatggaaccagccggattttgcggctttgggatcagagtgtatcgggaaatccaccagagggatatgagattggaacggaatatacaaaagagcaaatagaggaagcgttggcaaaaaggactcccgcagagcggtatgcggttgttccgagccgagatttgagcgggcatggaacaggtgtgatgggaattgcagccggaaatgggagagcgtcaaaaggagtctatcggggagttgcacccaaaagtgaattgattgtggtgaaacttggaaatccaagagcagaaggatttccgagaacaacggaattgatgcaaggaattgattactgtatcaaaacggcagtcaggcttggaaaaccacttgcgttaaatttgagtttcggaaataattatggttcgcatgatggagaatccctgcttgaattttatctggataccgtggcagttatcggaagaaatgttatctgcgtgggaaccggaaatgaaggaaataaagcaacgcacacttcgggagtactgggtaattcaaatgaagtcgttcccctgcaaattggagactatgagcggagcatcaacctgcagatttggaaacagtatgtagatgagatagagttttctttggaacacccaaatggagaggttgcaggaccatttcgggaagagcttggaacacagagatttcgtctggaaaacacagagattttgatttactatggagagccaaagccatttagtacagcacaggaaatttatctggattttattccggttaacacttatgtggataccggtgtctggaaaatcaatctgattccaaaaagaatcgtagatggaacgtatgatatgtggcttccatcgggaagtgtgctcaaccaggggacgagatttctttatccaatgccggagacaacgcttacgattccttccacagcacagaaagtggtttctgtcggagcttatgattccagatatcaggcagttgcagatttttcaggtaggggatatacaagagaaaaccgtctgataaagccagatatcgcagcaccaggagtaaatattatgacaacagcggtgggagggggatatcggacacagagcggaacttcctttgcaacgccatttgtaaccggaagtgcagcacttttaatggaatttggagttgtgagaggaaatgacccgtatttatatggagagaaagtgaaagcgtatttgattcgaggagcaagacatttactgatagaaccgtatccgaatcaattgttggggtggggagcgttatgtcttaaaaacagtattccataaaaccaaaagaagcaaaaatcttaaaccagaaaacacagtcacctttggttttctggtttgcgtttctttgtgttagatgataaaattaataagaaatataaagagggcaggttaaagttatgacaaaaatatggaagaagatagtagtaatttggctcatagccgtaatagtattacctttaatgacaggcatgcaggtttgggcaaagacagagccaaaacagcttgatatattgtttacccatgatacgcattctcatctgaacagttttacaacaatagtaaatggtgagaaagaagaggcaggcggttttgcaaaattaaaaacattgatagatgagcataagaaagtgaatccagatacacttgtactggatggtggagatttttcaatgggaacactggttcagacggtatatgacacagaggcagcagaacttaggatgcttggtcagataggatgtgatgtgaccacattgggaaatcatgaatttgattatcaatcaaagggactggcagatatgttgaatgcagctaaaaattctggtgatacagtaccgagtctggtattgtgtaatgtagactgggatgcaatggaagaagcaggtttaagtgaaggtcaaaagcagatacaatcagcatttgagaaatatcaggtgaaggattatgtagttgttcagaaaggtaatataaaaatagcggtacttggtgtatttggaaaagatgcacttgtctgtgctccaacctgtgaattggtatggaaagacccagtgaaagcggcaaagcaaacagtagaaaaaatcaaaaagaaggaaaaggtagatatgattgcctgcgtgtcccatagtgggacatgggatgaggcagacaaatcagaggatgagattctggcaaaagaggttccggatattgacttgattattagtgggcatacacattcacaattagacaaaccaattcagcatggaaatacatatattgtatcctgcggtgaatatggaaaaagtcttggaacaatttccatgacacaaaaggatgatggacggtggaaggcaacctcttatgagctgattccggtatcggatgaagtgaatccggatgagacaacacaggcaaaaattgatgcattaatggatacggtagatataaattatcttgcaaagtttggatatacaagaaaagaagtacttgcagaaaatgatattgaatttaatagtctggatgaaatgagcacgaggcatgaggaattaaatcttggtgatataatatcagatgcttatgtatatgcagtggaaaattcagataactacgatggagatccggtagacgtggcggtagtcccaagtgggacggtacgggatacttatgcgaaaggagaaattacggtagaagctgtctataattctttttcactgggaatcggaaaagatgggctggcgggatatcctttaattagtgcttatctgactggaaaggagttaaagctggtagcagagattgatgcttcgatttcagattttatgacaactgcaagattgtattgcagtgggttgaattttacctttaatccgcaccggatgattttaaataaagtgacagattgttatctgaccggacaggatggaaaacgagaagaaattcaggatgataaactctatcatgtagtaacagacctttacacaggacagatgttaggttctgtgatggatatctcttatggtttattatcaatcattccgaaagacaaagagggaaatccaattgaggatttggaagaatacgcaattatggaagaaaatcaggaactaaaagcatgggttgcaattgcaaggtatatgcagtcctttgatgatacagacggcgatgggattgcaaatgtatctgagtattatgcaaccacacatggacgtaaagtagtagaaaatagcagaaaccttgttcaattgttgaaaaatccaaacaagttttttatgttaatgattggaatcgttactgtggcagttttgattgttctgttattgattttctttattcgaaaggtactccgtaaacggagataataatagccaagggtaacggagttttctatgatgaaactttatcctaaaaaaaaaggaatgagtaaaaatgaaaagaattgattttgaaaatggaactgtgacgggaaatattcttggtgccgctcttccaatgcttgtagcgcaaattttgagtcttttatataatattgtagatcgtgtgtatatcgcaagaattccagaggtgggaacggcagcacttggtgcagtagggttatgctttcctttggttgtaattattactgcatttgcaaatctgtttggaagcggtggtgctccgttgttttctatctacagaggaaagaagaaagagcaggaagcaggacgtatcatgaatacctcgttttcgatggtctgttgcagtgcggttgtcttaatgatgattggattactatttgcccggccgcttttgattttatttggagcctcagagagtgccttggtttatgcatatccgtatatgatgatttatctgattggaacactgccatctatggttgcagtaggaatgaatccttttatcaatgctcagggatattcaacaatcggaatgttttcggttgcaattggagcaattgcaaatttactacttgatccgttgtttatttttgtattgaattttggagtgcgtggtgcagcaattgcaacggtactttctcagggtctgtcagcagtatttgttttgttctttcttaccagaagatctgaattaagagttcattttcttaagaaagaagagatttctgaatgcatcggatatgcgaagaatattgtcagtctgggcacttctggatttatcatgcagcttacaaatagtctggtgagcatttgttgtaataatgtgctttctgtcacaggtggagatatttatatttctgttatgacgattgtttcgagtgtgcgtcagttagtagaaactccgatttatgcaatgaatgagggtgcttcccctattttaagttataactatggagcccgtcgtccggcacgtgtgcgaaaagcaggagttataatggcaagtatgattttgggatatacggttgttatgtggagtgtaattattttagcgcctcatgcgctaattcggattttcagttcagataaagtactaatgaaagatgctgtgattgcattaaaacagtattttgcagcatttatctttatggatctgcagtatattggacagacagtatttaagtcactcaataaaaagaaacaggcaatctttttctctctgcttcggaaggtatttattgttgttccactgacttatctgatgccttatgcattacatatgggaacaagaggtgtatttctggcagagccggtatcaaatgtgattggtggaagtttttgttttatcacaatgttaagtaccatattgccagaattaaaacgtatggagaattctgcaaaataaaaaactaaaaaaatgcttgcattttctgaaaattgtggtattatagttaatgcattgcgatgcgggtgtagttcagtggtagaacaccagccttccaagctggatatgtgggttcgattcccatcacccgcttttttgtatttatcattaattatggcttgtaaaatcagatttgattttacaggctattttttttataatgaaaaataaaaaaagaaagaagtaaaagacattgagagatttactggaacaattagagaggagaagtttagatgaatcaatttacgggatatgaattattatggttgtttctaatttattcttttttgggatgggtgctggagacagtcattgcaaccgtaagacagcgaaaggtggtaaatcgaggattaatcaatggtccattttgtattatttatggaattggcgcagtattgattaccatatggttacaggagctgagcgggttatggttgtttttattttcggcagtttatgcttctgtggtagaatggattgcagggcatctgattcagaaaatttatcatgagagatggtgggattattcagatattaagtggaatctggatggatatatctgccttccgttttcaatcatctggggtgctctgggatttgcaattgtaaagtggggaaaccgaatattaattgatttttttgcaatttgcccacaatttttaatgcatctcgttatctggatattgattggagtgttggcagttgatgcgctggcttcttatattttagtacgtggaacaagcaaagaactggataaatgggaagaggcaaataatcgttttgttcatgtaagtgtaaaatttgcaaaatggatagcaacgcatgtagaagatcgtattcataaggcatatccgaaagcagtaaaatcaaaagttttaactaaaaatgagacagtatttgcagcaggatgtggtttttataaaatagtgatgctgttttttatcggggcatttttaggagatatcacagagacgattttctgccgtatcacagcaggcgtatggatgagcagaagcagtgtggtgtggggaccttttagtattgtatgggggcttgcaattggtgcagttactgccttactttataaatataaagacaaaagtgacagttttttatttaccgcaggaactttgcttggcggagcctatgagtatttgtgtagtgtatttaccgaaatgatgtttggaaaagtattctgggattatagtaagattccatttaacctgggtggaagaattaacttattatattgctttttctggggaattgcggctgttgtatggtttaagaagttatttccgttttttgaaaaaggaattgaaaagataccgataaaaattgggaaaatggtgacctgggttttaattgtatttatgagttgtaatattgtaatgtcttgtctggcactgattcgatatgaccagagaagtaatcagatagaagcgaaaaatcaaatcgaggtctggctagatacgcattatgatgatgtgacaatgcagaggatttatccaaatgcaatagaagcaaaataaatgaatgcacgacaaacgcatgagtaaataaattgtgaacacacctcttttaaatagaaaaaaaaagaattggcaatggataatcattcatgcgtttattgtgaactctgtccccaatatcttgacaagtgggaacagatattataaaatcaacatattagacgaataggttatgaaggcggatgtaaggaaagatgcatccgcctctttatgatataaggagtgaagaaatgttaaatcaattttcaagaacagaattgctgttgggaaaagaggcaatggaacgtctggaaaattccagagttgcggtgtttggtgtcggaggtgttggcggttatgtctgtgaagcactggttagaagtggagtcggagcatttgacttgattgatgatgataaggtctgcctgaccaacttaaaccgacagattattgcgacaagaaaaacggtgggtaaatacaaggtagatgtgatgaaagagcgaatccttgagattaatccaaaggcggatgttcgaattcataagaccttttttctacctgaaaatgcagatgaatttccatttgaggaatatgattatgtggtagatgcagtggacaccgtgacagcgaaactggaacttgtcatgaaggcaaaagagaaaaatattccgattatcagcagtatgggtgcaggaaataaattagatgcgagtgcatttaaagtagcagatatttataagacaaaagtctgcccgcttgcaaaagtcatgagaagagaactgaaaaaaagaggtataaagaaattaaaagtcgtttattcagaagaacagccaatccgtccaattgaggatatgtcaatcagctgtagaaccaactgtatctgccctcccggagcaaaacataaatgtacggaacgacgtaatattccgggaagtacggcatttgttccatcggtagccggtctgattatagcaggtgaagtgattaaagatttgtgtaagaaaaacgaatgttttttatagacaggaactgtctctgtgaggggacaagggttgaaaaaatcactccattctgctatagtaaaaagacgaacacgtgatgaaccacgttactaaaaattactggagaagttttatgagtgaaaaaatacaagttctgggtatttcagttgagaaatgctatgtggacgaagtaatggacaatattaacgaaaactggaacagggatgatgttctggcaacttacggtgtgattaacatgaaaattcttcttgcagcgcagaaagatgaggaacttaaggaatacatcgacagtctggataagggagttgtggatgaaccggaagtattagaggctgcaaatatggatgacacgcgtatggaagaggaagtgcttgggcatagtttctttgcaaccttgttctggtatctctcccgttatcagaatcagatttatctgcttggagagacggaagaagaggccaatgcattttttaattacgtcaaggagaaatatcctgaaatcgtggttcttggaaagggcagtttaaaagatggcagtgaggatgactgcgataagattatcaatgatattaatgcatttgcaccacaggcggttttagggtgttccggagatttcagtatcgagcgttttgtaaaaaaacatcgaaaaaaaatgaatacaagagtttttttctgtcttggagaacgtgcagaaatccagaaagaaaccggtgtaaaaaaacgctggttggaaaaaatactggagaaaaattcttttaaaaaattagtctcccagttcaatgaggatgagaaaaattaagagacatcactgcaaaaatgataaagagaaaatatgaacaaaatgttacattttgaaaaaaatatgtaatattttgcattttccctttattttttttctgttatgtattactatataaagtgaggtttttgttttttggggaaagaacaatgcgtgtcagaacagccaaaaaaagaaagttaaagctgtatggcgtagaataaactatatgatgaaagagggtatatacatgatttcaaaccaggtattacagaacacgttagatggacttcgttccataaccagaacagatttgtgcattactgatacagaagggaaagtgctcgcatcgaccttttctgaaactgtatgtacagaggatgaagtgttggcttttgcacagtcacaagcagacagtcaggtaattaaaggatatcagtattttaaagtgcatgatgaccatcagttagaatatatactggtgattaacagtgcaggagaggatgtctacacacttggaaaactggttgtttttcagattcagagtcttctgactgcatataaagagcgttttaacaaagataactttattaaaaacctgttgttagataatctgcttttggttgatattcataacagagcaaagaaattacacatcgaagttgaccagcgcagggttgtgtttattctggaaactaatcaggataaagattatggttctttagagaatgtaaaaaatgttctcggaggaaagaatggcgattttgtcacagcagtcgatgagaaaagtattattattgtaaaagaactttcagaaagcgacaattacccacaggtggataaaattgcaaatacaattctgacaacccttggagttgaaaaagacagcaatacccacattgcttatggtacgattgtaaaagaattaaaagaagtatcacgttcctacaaagaagcacgtatggcactggatgttggaaagattttctttggtgaaaaagaagtaattgcctacagttcacttggtattggacgtctgatttatcagcttccgattccgctttgtaaaatgttcattcgggaaatattcgacagcaaatcaccggatgattttgatgaagaaactttgactacaatcaacaaattttttgagaacagcctgaatgtttcagagacctccagacagttgtatatacacagaaataccctggtttaccgtctggataaactgcaaaagagtacaggtctggatttgcgggtgtttgaagatgcaattacatttaagattgcgttgatggtagtaaaatacatgaagtatatggaaacacttgattactgatatcttaaagaggggtcagatatcaggaaaacaggaggatttttatgattgatttaaatggcgtgagtaaatcatacagcaagggtcagccggcacttgacaatgtgagtctgcacgtagatgagggtgaatttgtttttatcgtaggaaacagcggttcaggtaaatctaccctgattaagcttctgttgaaagaacttgatccgacagccggaacaattacagtaaatggctatgcattaaataagttaagacgcggaaaggtcgcaaaataccgcaggggaattggagttgtattccaggatttccgtctgctcaaagacagaaatgtctatgaaaacgtggcatttgcacagagggtaattgaaaaaccgacacgtgtgattaaaaaacgagtgccggaagtattgactttggtaggtcttgcagaaaaatataaatctcgtccggatcagctctccggtggagaacaacagagggtggcacttgcaagagcacttgtaaaccgtccaaacattctgcttgccgatgagccgaccggaaaccttgacccgaagaactcttttgaaattatgaaactgcttgaggaaattaatgagcgcggaacgaccgttcttgtagttacccataacagagaaatcgtaaatgcatttaagaaacgtgtaattacgatgaagaaaggcgtcatcatcagcgacgaacaagaaggtggatatcagtatgagagttagtacgatgacatacatattgaaacagggatttaaaaatatctggagaaatatccgattttctttagcatcaatcgcaacaatggcagcctgtattttcctgtttggaattttcctctctctggttatgaacttccgttacatggttcattccgcagaagaaggagtagcagttgtcgtttattttgatgagggtgtgaaacaggaacagattgatgatatcggttctaaaatcaaaaaaatgtcggaagtagaacgtgcagagtatgtatctgcagaccaggcatgggaagcatttcgggatgaataccttggtggtgatgacacacttgcagaaggattccgtgaccaggataatcctctggcaaattcagcgagttatcaggtttatttaaaaaatgtagaatcacaggataaagtagtaaaaaaaattgaaaagatggatggcgtgcgtcaggtaagccagtcacagtcggctgcaaaaaccctgtctacattcaataaactgattggatatgtatcattagcaattatttttattttacttgcggttgcattttttcttatcagcaatactatcacaatgggtatttctgtacgacaggaagagattggaattatgaagctgattggtgcaacggatttctttgtaagagttccatttgtaattgaaggaattattctgggaattatcggtgcagtaattccgatggcagtgctgtatggactttataatcaggttattaactatgtaatgacaaaattccatcttctcacaggcttccttcagttccttgacgtatggcatgtattcagaattttacttccggtcgggttaggtcttggaattggaatcggattctttggaagtattctttctgtaagaaaacatttaagagtataataaaagtgtcaacagagatatttaggcaaattagaaggaggtatagccaggaaaattctggctgtatctccttgttttgtgaaaggagacagaaaagttggaaaaaaacaaagtaaaggggtttgtgaccggtgtattgtgtaccgtactggtaggcggtgggatatttggaggatgctatgtcttgtcgaataaagaccatgcggtaaatcaggaatcggttcagaaagcaaaagcaatcgaaaacctgattgataaatattatctggataaaattgacaatgatgaactggaatcttatctctataaggggttgatggctggacttggcgacccgtattctacttattatacagcagaagagtataaagaactgacagaagacaccgaaggggtttatcgtggaatcggtgtgacgatgcaaaaagatgtgtctaccggagcagtgaccgtcgtaaaatgttttgagggagcaccgggagcagaagcaggattacagccgcaggatcagttagtcaaggtcaatggcgaggatatcacagacaaagaactcagtgaagtcgtaaaaatgataaaaacttcggaatcagataccgtgacactgactattttaagagaaggcgaaagcgattaccgcgaagtagaagtaacgcttgataccgtagaagcaccaatggtagaacatgaaatgctggataataagatcggttatattacgattaaccagtttgcagaaactacggcgagccagtatgaaacagctttagaagatttaaataatcaggggatggagcgtctgattgtagatgtcagagataatccgggcggacttttaacttctgtatgtgatgtcttggattcgatgcttccggaagaactgcttgtttataccgaagacaaaaatggcaagaaaagtgaatataatgcaacaggcactgaccagtttgacaagccgatggtaatactcgtaaatggaaacagtgcaagtgcagcagaaattttttccggtgcgcttcaggattacaaagtggcaaaactggtaggaacgaccacattcggaaaaggaattgttcagcaaatctttaatctttctgatggaagtgcagtaaaaatgactatttccaagtattatactccgagcggaagatgcatccatggaacaggtttagagccggatattgaggtggatttgccggatgagttaaaaaatcaggttagtattgataagagtgaggacactcagcttcaaaaagcgattgagactgtaaaagaaatgcagtaaaataaaaaaataaaaaagttaggagaaacagcctatgtataattttgtaattctgacagataataccgtagatatgccagttgaatggttaaatgaacatgaggtaggttatgaatgtcttccgtgcagtatgaacggagtagtttatgataaaaagaatccgattgatacaaagctgttttacaggcagatgagagaaggagcaatgccgacaacttcccagatgaatccggcaatggcagaggcaatgtttgagacttatttacaggagggaaaagacattttatatcttgccttttcttccggtttgtcggggacatgcaacagtgcccgcatagcagcagaggaattaaaagaaaaatatccggaaagacaaatcaagataatggattcattagctgcatccatgggggaagggttactgctctattatgcagtaaaattaagagacaagggaaagaacctggatgaaatctgtgactggctgttggaaaacagactgcatctgtgccatgtatttacagtagatgatttaaatcatttacacagaggcggaagagtttccaaggcaactgcagttttaggaacactggcaaatattaaaccgatgcttcacgtagataatgaaggaaaactgatttcaattggaaaggtcagaggaagaaagaaatctcttgcaacgttagtttctatgatggaagaacgaattggaaaatattgtgataaaaatgaagccgtgtttatcagtcatggagattgtgaggctgatgccgagtatgtggcaggactggtaaaagaaaaatttggaattgaaaatattatgattcatccgattagtgcaacgataggagcacattctggtccggggacagtagcgctgtttttccttggagaataccgctaaagaaaaaatcagagctaaaaaagcgataggaagtaattttggaggaagcaaatgaatttaaactttaaaccggtagaagcagaagatttggaaaaactaaatccgtttttctgtaaacgaccgaataaaacctgtgacagtgtgtttttagacagctttatctggagagagtattataatgtaagatatgccgtcagcgataataaggcaattttatggctgatggatttagatggaaaaacaggttctgcaatgccgatttgtagtgaagaagatttagaatattatttttggaaattggtggaatattttaatacagaattaaaggcaccactgtatattaatctggcagatgaagaagccgtagaacagttaggtttaaaaaatatgccggataaatttaagattacagaacaggtggatttaaaagactatctgtatgatggaaatgcaatgcgtaccttgtctggaaaaaaactgcataaaaagaaaaatcatttaaatgcttttaaacgagaatatgagggcagatatgagtaccgccgtttgtgctgttcggacagaggtgatgtctggaagtttttggatcgctggagagaagaaaagggcgaagaggtagaagagcatctggattatgaagtgcgtggaatccatgagattttaaagaattgttcgcttctgaatgtcagaatgagcggagtttatattgatggtcatttagaagcctttacgattggaagctacaatccgttggaacagatggcggtgattcatattgaaaaggcaaatccggaaatcagaggattgtatcagtttattaatcagcagtttttgattgaagagtttccggaggctgttttaattaaccgtgaggacgatttaggcttagagggattaagaaaagcaaaactttcttataatccaattgactatgcaagaaaatatcaggtagaacagatttggtaaatcggagcgttgatttgatatgaagaacagatatttaagcaacgaggaaaaaagagcctgcgaagggctctggagtgaagcatttttcgaggacagtgattcctttcgggaatattattttacagagaaagtaaagacaaatcagatactcgtggcagaaaaagacggacaaattttgtctatgattcatcgaaatccctatcagttgaatattaaaaatcaaaaagtaatctgtgattatctggtcggtgttgcgacgaaaatagaaaacagaggtcagggatatatgcgaagtctcttaaaacaggcatttttggatatgtatcaggaggatatgccgttttgctttctgatgccggcagatcgtcgtatttatgagccgtttgattttgtgtatgtatttgaccagccggtgtgggaattaaaatcaaaagactggctggaacaggacgtgacagaagagtcggcaaaggaaatcgcagactggatgaatgagtggttaaatgcacggtatgatgtgtttacatggcgggatgaggattatgtgaaagttctgctgaaagaattaaaaagcgaaaatggaagtttagaagcattaaaagcaccggaaaatccacatcagataaaggcattaagggcagagtggggaatggagaaaaaagaacagcgtctgctttatgccaatgctgatgactgcaaaaagataaaacaagaacctgcaattatggtaagaatcgtgaaccttccagagtttttgaaatatatttgcctgaaagataatgtagcagagcaggaagtgctttatcagttaaaggtaagagataaactgcttgaaaagaatgatagaatctggatttggcatgtcaatcacaaggagtcttttgttgaagtattcgatggaaaagttttttggaagaaagagtcagatgagcaacaggagaaaaatttacaaaaagaacgaaccatagaacttgaaatttcagaactgacatcgtggttattgggatataaaataccagaaaacataagtgagactgtaaaagcagaaatctgttgtatcaataggattttcttagatgagattgtttagtaaagctgtttcattcatgcagcacaagagaaaagagggaaaacgagcatgcaaacagaagaaatgctggaagaactgttaaaaaaggcaaaggtggatatgtcacttcggcagaaattatttgatacaagaaatgagaaaaatccagtttccgcattttgtaaaacttgcagagaattggggtacgaaatctatgatatggatttaatcagcgccggagaagaattttacgcaaccatgagaagaagtacaaatggtggaggagaaaattctccaatgctggagggtgaagatgatttctatgaactgttttttgcaagtctggaaagtttataaggaatcgttctgctcccatgcagttctaataaaggttagaaataccttggaaaagataaagaggaaaaagaaatggaaatagaaatacaaaatattattaaaattgtggaagatgcagcaggaattttatcacaaagagatttgattggagatatctctgtgaaaggtccggctgatttcgtaactgaggcagatagggatattcagcagtttattcaggcggaacttctggttcagtatccggacattcagtttcttggagaagaagacagccagaaagaggtagatttctacggaaaaatgtgggtgcttgacccggttgacggaacgacaaatctgattcatgattatcgttccagtgcaatttctctggcgttgtttgaggcaggaaaaccggttcttggaattatttatcagccatatacaaaggaattattctgggcgcagaaaggaaaaggggcatttcttggcacagaaagaatttctgtcagtgaggctggttctctttctgagagtattgtaaatgttggaacatctccatataaaaaagaactggcagacgaaaattttgagctgattaaaaaggtattctgtaaaagtcaggacatcagacgaagtggttcggctgccttagaccttgcatggattgcctgcggacgcagcgatgcattttttgagcgcaatctgaaattatgggattttgcagcaggctggataatcattgaagaagcaggcggaaaaatagcagattttaatggtatggaaataagcccggtgattgctgcggatattgttaccggaacaccaaaagtctgtgaggagcttttgacacttatcaaagaaaattgaacgcagataagcattccaccgcttcaagtatgcggagcactaagcggcgggtgagggggatgcttctgtcagtgggagtgaaagctcccgctgacagatcgcaaagcgactgcgttcatgagcaagtagcgaagtggattgcgaatgtccgctttacattaaaaagaagcacggaatttagagggagagactccatactgctttttgaaggctttgcttaagtgaaattcatcataaaatccgaagttcagtgcagcctcgtgaagttttgcgtctggttgatgaatcagaaaatcgcgtaccatttcaagctttgtctccatttgataagcataaaaggtttttccgtaatttttaaaaaaatggttatttaaggtacgggcacagatataatagctgtctgcaatttcggaagcggtataaaaaacctgaggattggattgaagtttctgcgtaacctcttccaaaagggaatcggttttatgattggagcagatgttatcatttaattcatgaatttcgcagagcataagattaaataataaagaaattcgatgttctttctgggggcttttcgaccagtaggcacgaataatattttgaaaataagtgcggattagaatccgttctttacagtgcaataaggtatggcatggaaaagtagaagaggattccattttttccatgctgttttttgtggatgaaaaactctgccttttagaattaagaacgtgtttgctgtcagattccaaagcggtaggaaggacgtgcaggtacatgtgacgattgccggcattgcagggaatccgtccatagtgatggcgtccggcagatagaattaacaaatcatcttttgataaatgataagccttgtcttcttcaaagatttcccattctccatctaaaatatataaaaaatcgtgcacatccataatccggtttgggtgaaccattccgtttacggaagtgatataatttgcaccggttatccggcggtcagccatttcttctaaattcagcataaaaaaatcctcctctgaaacagaattaatacagaatgattaaaatctgaaaattcatatctttccaaattatacatgtaaatttccgaattggcaatggattccacaggctcaaaatgctagaataaatataacgatatgagtgtcaaaagtacatcaaaatgatttgggaggaaatttacatggacaagacaaaattcagcagaccactttctttaaaaaacgtacagattacggatacattctggaaaaaagagatggaattagtaaggacagaagtaattccgtatcagtggagagctttaaatgatgaggtagagggtgcggcaccaagtttttgtatgcataattttgaagcagcaggcagacagaacgaggaaagaagagagaaaggagcagaatttaaagagccggtttatacatttcgtggatttgagacgcttccggaagaccctgagcatctcgaagacaagttttacggatttgtatttcaagacagtgatttttataaatggattgaagcagttggatattctttaagccagcatccggatgaaagattagaggcgattgcagatggtgcgattgatattgtctgcaaagcacagcaggaaaatggctatctggacacttattatatcttaaatggaaaagataagatttttacaaatttaaaagacaatcatgaattatattgtctaggacatctcttagagggagcagttgcctactatgatgcaactggaaaagacaaattattaaacgcagcaaagcgttatgcagattatgtagattcctgctttggaaaagaagaaggaaaatgtaaaggttatccgggacatgaaattgcagagatggcactggttcgtctttatgagacaactggcgaagataaatacttgaatctggcacgtttctttattgatgagagaggaacaagaccatattattacgacaatgaacatccggaagaagtgaaaaagaaaccagacggattgcgctatgaatataatcaggcacacaagccggttcgtgaacaggacgaagcagtcggacattccgtacgtgcagtttatctttacagtggaatggcagatgtggcaagactgacagaagatgaaagtctgttaaaagcgtgtgaagtgctctggaacaatatgacaagaaagaaaatgtatattaccggaggaatcggtgcaacccatattggagaagcattttcctttaattatgatttgccgaatgatactgcttatgcagaaacctgtgcatccattggactggtatttatggcaagaaggatgttagagatgacgccggatgcaaaatatgctgacgtaatggagcgtgcattatataatggagttttaagtggaatggcattagatggaaagagcttcttctatgtgaatccattagaggtgcttccggaagcctgccacaaagatgagagaaagttccatgtaaaaccggttcgtcagaaatggtttggatgtgcctgctgtcctccaaacattgcaagattattaagttctatcagtacttatgcatacaccgaaaataaagataccttatttgtacatctgtacattggtggagtaattaaaaaacagctggatggacaagagatcgaaatcaaagtgacatctgaatttccatgggatggaacagtaaaagtaaaaatgcctgcaaccgaaaaaccatttactctggcatttagaattccacggtgggcaaaaaattatcaggtaaaaggcatcgatggtgccaaaacagaagaaaaagccggctatctctatgtgacaaaacagtggactggaactgaaacagtagaattggaattcccaatggaagtaagactggttcagacgaatccaaaggtaagggaaaatattggaaaaatcgcagttgtaaggggaccgattgtgtattgtctggaagaagcagataacggtgcagatttacatttagtacgtttaagtccaaaggcagtttgtgaagtaaaggctgagaaaatcgcaggagaaccggtaaaaacagtgctgacagagggattacgccagaaaaattcagaaaatccagaagaggaagaactgtacaccatcgcagaaccagataccgaagttccggctgatttgaaatttattccatattatgtatgggcaaacagaggcgaaaatgaaatgatggtatgggtgaaaaaagcgtaaatccagcagaaactgtagttgccaaagaaaataaaaaagcatataatagacctgtaattgataaaatgagacatcaaagaacagatggagaaagagaggtcttaaatgtattgcacaagaaaagtagcagatgatttaatctgggtaggagcagatgacagaagacttgccatgtttgagggcgtgtattctgtgccaagaggagtttcctataattcatatttattattagatgaaaagaccgttgtatttgataccgttgaccatgcagtagagaaaacatttctcgaaaatgtagaacatggattaaacggaagaactttagattatcttgtagtacagcacatggaaccggaccattccgcaacaatccgtactctgttgatgctatatccggaagcagaagtggtatgcagtaagaaaacagaaggaatgttacgtcagttttttggcgatgcagttaagatgaacataaaagtagtcggagaaggggataccttaaaaaccggaaaacatgagtttaccttccttgctgcaccgatggttcactggccggaagtcattgttacgtatgatttgacaaccaaaactttgttttcagccgatgcttttggaacatttggcgcattaaatggcgcattatttgcagatgaagtggatttcttccgtgattatctggatgaagcacgcagatattataccaatattgtaggaaaatacggtgttcaggtacaggctttattaaagaaagctgcaactgtggaaattcagaccatttgcccgcttcatggatttgtatggagagaaaatatcggcgcttatctggaaaaatatcagaaatggagcttatatgaaccggaagtaagcggtgttatgattgcgtatgcgtctgtatatggaaatacagaaaatgcagccaatattcttgcatgcaaattacgcgataaagggattaagacaaccatgtttgacgtctctgtagctgaaacttcagaagtagtcgctgcgtcctttcagtacagtcatctggtatttgccgctccaacttacaatggcggaatctttattaagatggatgaagtactccgtgatatcgaggcacacagcttaaagaaccgtaccgtagcatttatggaaaacggaacctgggcagtgacctgtggaaagcagatgaaagaaatttttgcaggattaaaaggcatgaatattatagaggatactgttacaattaaatccgcactcgcagacggtcaggaagcacaggtagaaaaactggcagaagcgattgccgaaaccatgtaaaaaaaacaaaatcaaaaataaaaaagaaccaatggttaatgacggttgaccattggttctttttaagtttatctttattattaaaattagttcagagtattaacagctttagataaacgtgaaacttttcttgctgcgttgtttttgtggtaaacaccttttgtagcagctttatcaattgtagaaatagcgtttgctaatgctgcaactgctgcttctttatcttttgctacaactgctgcttctactttcttgatagaagtcttaactgctgatttgatagatttatttctgtcagcttttttctggtttactaaaactctttttttagcagatttaatattagccaaatccgtacacctccaaaattattatatttcgtattcgtatgtttattatctgataccaaagaagacacgggcactttggtattcacatgcttttttattctagtttatttattgcaaaatgtcaatacataaaatctatgaaaatgcaaaaaatagaaataaatctgatgaagagggagaaaaacagcatgattcgaggaagaatacacaccgatttggcactggaagcaaaagaaagatatgaggaggataatgtagaaatcaggggcgtctgtattgaagaagagtataacgaggaaaaagatatccgtacgactttggtaaaaattgaaaccgaaaatggagcacgggcgatggggcgtccgcagggaagttatctgactttggaagcaccgaatctatctataccggatgagggttatcacagagaaatttcggaagaactggcaagacaggttaagaaactgataccggagaaaaaagaattgacggttttggtggtgggacttggaaatcggcaggtcacacccgatgcgctgggaccggatgtggtggacaatttaaagatgacccgccatataattttagaatatggtgcacaggcaatgggagaacaaaatatgtatcaagtcagcgggctcgttccgggggtgatggcgcagactggaatggagacacttgaaattgtaaaaggtgtgataaatgagaccagaccagatgttgtgattgtggttgatgcacttgcggcaagaagtacaaagcggttaaatcgtacaatccagattacagataccggaatcattccgggctctggtgtaggaaatcacagaaatgggctgacaaaggagacacttggagtaaaggtaatcggaatcggagtgccgacggtggtggatgcagcaacaattgtacaggattcaatggaaaaactgcttcagacattagaagaaaaagaaaagaaagaatttctggaggaaatgattccaccggcgttatacagcatgtttgtgacgccaaaggacgtggatgagacaatgaaacggttgtcttatacaatttcagagggtttgaaccgagtattttgttaaaaagcaggttcagaacttatctgtgttcatgagcaagtagcgaagcggattgcgaatgtccgctttacaaggcataaagcgcagggattgtctcatataaagataggaggtgatagggggaacaaaatgagagaaggaaacaggacaaagctggttttatggggaatttttatcgttcttgcaggatatctgagtttgaaggggctctcttttgataaagagacatttgtatggatgggaataaatctggaagagcaggcagtcgaggtttatctcccatcgatattagaatcggatggaaaagacgcatcgcttagtgccaatattttaagtgggttatttgtaagaggtgggataaatgtacgaagcatttcggaacaggcgggggcagattcggaaaccgaccggaagattatcaaagaaaatgaacaatttttagttgaaaatctgacaaaggaaaatcaggaggcgggaccgaaagaaaaaaatcaggagagtacaggaatggatagtgaggaaaaaagtgcagtggaagaaaacatgcaagaaaatacggaagaaagtacgcaagaaaatacagaagaaaagattgaagaaaatgcaggaacggaaaacgggcagaaggggacattgacagccggtgccccggtcatggaccttccattggagcagtttcaggattttaattttgtcatcagcaatttttatacgatagataagacaaccagcattaacagtgaacagcttaatgcagtgacactcttggaaaaagatttgcggatgagtgcaggggcagaaaatccgcagattctgatttatcacagtcattcacaggaggaatttgcagattctgttccaggggatgcttccacaatgatagtgggggtgggagagtatttgacgactctgcttcgggatacatacggatacaacgtcatgcatgtgacagacacatttgatattatgggtggaaaattagacagaaataaggcttataactatgcacaggagaccatcagccggattttggaggaaaatccaagtattgaagtggtgattgacctgcacagggatggagtaaccggtgcgaaacggctggtgacggaaataaacggaaagccgacggcaaagattatgttttttaatggtctaagccggacgaatcaaaatggagaactttcccatctgccgaatccttatattcaggataatcttgcattttcgcttcagcttgcgcggtatgccaaagaatattatccggactggtttcgtacgatttatctaagaggatatcgctataatctgcacttgagaccaaaagctttgctggttgaatgtggggcacagacaaatacggtagaagaagaaatgaacgcaatgcagccccttgcagacattttgaacaaagtgctgacaggggcatgaaacgcttgcgcatgcagggaatctcgtgctatactgagcgttagcaagagataaaaatcactttaaaattaaaataaagttcaagttgaaaaacagtttagaggagaaaaaacgaatttatggcaggaattgaacaaagtaaaatcagaaatttttgtattatcgcacatattgaccatggaaaatccacccttgcagaccgtatcattgaaaaaaccggtcttttaactgcaagagagatgcaggcacaggtgcttgataacatggagttggagcgtgagagaggaattacaatcaaatctcaggcagttcgtattgtatataaagcaaaggacggagaagagtatatttttaacttgattgataccccggggcatgttgactttaactatgaggtttcaagaagtctggcagcctgtgacggtgcaattttagttgttgatgcggcacaggggattgaagcgcagacacttgcaaatgtatatcttgcactggaccacgatttggatgtatttccggtcatcaataaaattgacctaccaagtgcagaaccggaacgtgtcaaaaatgaaattgaagatgtcattggaatcgaagcacaagatgcacctttgatttctgcaaaaatgggactcaatatcgaagaagtgttagagcagattgtgacgaaaattccggcaccgacaggggatgcgtctgcaccgcttcaggcattgatttttgactccgtctatgattcttataagggtgttattgtattttgccgaatcaaagagggaacagtaaagaaaggtacacgtattcgtatgatggcaaccggagccgtagaagaggtagtagaagttggatattttggagcaggacagtttattccatgcgatgagttatccgcaggtatggttggttatgtcacagcaagtattaaaaatgtaaaagatacccgcgtgggtgatactatcacagatgatgagcgtccatgcgatgcaccgcttccgggttacaaaaaagtaaatccgatggtatactgtggtgtctatcctgcagatggttcaaaatatcaggatttaagagatgcacttgaaaaactgcagttaaatgatgcctcccttcagtttgaaccggaaacttcaattgcattaggatttggtttccgctgtggattcttagggcttttacatcttgaaattattcaggaacgtctggagagagagtacaatcttgatttggttacgactgcaccgggtgttgtttaccgtgtctataaaacaaatggagaaatgatggaattaacgaatccgtccaatcttccggatccatctgaaattgattacatggaagagccgatggtaaaagcggaaattatggtgacaacggactttattggaccgattatggatttatgtcaggaacgtcgtggtcagtatcagggaatggaatatatggagactacacgtgcacttttaaaatatcatcttccactgaacgaaattatttatgatttctttgatgccttaaaatcccgttccagaggatatgcttcttttgattatgaaatgcttggctatgagagaagtgagctggttaagctggatattttagtcaacaaagaagaagtggatgcgctttcttttattgtatttgaaggttctgcttatgagcgcggcagaaagatgtgtgagaaattaaaagaagagattccgagacagctctttgaaattccgattcaggcagcaattggaagtaagattattgcacgtgaaaccgtaagagcaatgcgaaaagatgtacttgcaaaatgctatggtggagatatttccagaaagagaaaactgcttgaaaagcagaaagaaggaaagaagagaatgcgccaggttggtaacgtagagattccacagaaagcatttatgagtgtattaaaattagacgaagattaagctattgtgacagtaataaagaaaagtaataaaaatagatcaaaataggtcagtgtgtgggaaggtagtaaaacaaatgaagaaggatttggggctgtatcttcatgtgccgttttgtgtaaaaaaatgcgattactgtgattttttatcaaaagaggcagcagaagaagaaaaagaggcgtacgtagatgcgctgataaaagaaataaaaagctataagaaatttgcggggaattacaaagtatcaacagtttttgtgggtgggggaactccgtcctgcttaagagcggaacagacaaaacgtatctttgatgcactttatgaaatctttgaatttgtcaaacatccggagattacaacagagatgaatccggggacggttgacagagaaaaacttgaagtttataaggcatgtggaatcaatcgtttaagcatcggcatgcagtcggtaaaagatgagaatttgaaagtgcttggacggattcacaattttgaacagcttctggaagcttatcagttgtcaagagaagccggatttacaaatattaatctggatttgatgtcctctttgccttctcagaccaaagaggaatgggaagaagaactgcaaaaaacagtggaattaaatccggaacacatttctgcgtatcagcttatcatagaagagggcacacctttttatgaaaaatatgatgcacatccggaacttctgccgaatgaagaggaaagcagagcaatttatcagacaacaaaacgtatcttagaagcaaacggctatatgcagtatgagatttccaactatgcgaaaccgcagaaagaatgtaaacataatctgcgttactgggagcggggagagtatcttggaatcgggcttggatcagcctctctgattcaaaatatgcgtatgaacaataccagagagatgagtgaatacctggaaaaatccgcagtgccaaaagagatgcgaaaagatgtggaatttttagagaaccgtcagcagattgaagagtttatgtttctgggacttcgcaaaacttatggtgtttcgaaaaaagaatttcaccgtgcctttggacgggaactcgaagatgtgtatggacagaccttaaagaaatttattgaagagggcatgataaaagagaaaaaagaccgaatctttttaacggaagacggggtactggtaagcaatcagattttatcagagtttctgttttaactgcctgatttttgttcgggctatcttaagaaatattagaaaaatttaagaaagttttagaaataaaatctggaaaaataaggacttctgtggcaaaataaaagacgcaggagttgacaggtatgttttgtaatggggacagagctacataaataaactccgaaagatggtaagagcgcatataagtttatgggaggctttatattatgaatattttatttttccttactccaaaaagtgatgttgcttatatttatgacaattacagtttaagacaggtgcttgaaaagatggaatatcacaagtattcctgtattccagtgattggagtggacggaaaatatgtaggtacaatcacagaaggtgatttgttatggggtctgaaagaacgtggggcatttgatttgaagaaagcagaagaagttccgattcgttcctttgagcgtagaatggattatgcaccggttcggattgattcggatatggaagatttgctcgataaagcacttcgccagaattttgttccggttatagatgaccagaagaattttatcggaattgtcacaagacgtgatattatgatgtatatggcatctgccgacagaaaatcaaagaccgaatcgaaaaaagtatatatggaaacagtaggttaaccacttaagtcaggataaaaattataagaaaaggacagtctaatacaggctgtttttttcttttacaaagttataaggagagtgttaaaagtataaaaacgtgtcttgaaaatgatacgaacaaatgtttgtaaataaaaaatccctgtgctataatgatactgttgaagttaatcagatcgcaagaaggaaatgaggaaaaatacattgagaaatcaggaacataaatttattaagatacgtggagcaaatgaaaataatttaaaaaatttaagtgtagacattccaagaaatgaatttgttgtgctgaccggtttaagtggttcaggaaagagttctctggcgtttgatacgatttatgcggaaggacagcgcagatatatggagtcgctttcttcttatgcaagacagtttttaggacagatggaaaagccggatgtggagagtattgaaggactgtctccggcgatttccattgatcaaaagtcaacgaatcgaaatccccgttctaccgttggaacagtaaccgaaatttacgattattttcgtttattgtatgcaagggtggggattccgcattgtccaaagtgtaaaaaagaaatcaaaaaacagaccgtagaccagatggtagaccagattatggcactgcccgagcggacgaaattccaactgcttgctccagtcgtaagaggccggaagggaacacatgccaaactgctggaacaggcaagaaagagcggttatgtccgtgtgctgattgacgggaatctttatgaattaaatgaagaaatcaaattagataaaaatattaagcataatattgagattgttgtagaccgtctgattgtaaaagagggaatcgaaaagcgtctgaccgattctattgaaaatgtgcttcatcttgcagatggactgatggtggtagataccatggatggaaacgtaattaatttcagtcagagcttttcctgtccggattgtggaatcagcattgatgaaattgaaccgagaagcttttcgtttaataatccgtttggagcgtgtccggactgtttaggtcttggatataagatggaatttgacgtggatttaatgattccggatcagagtttaagcattgccgagggtgcaatcgttgtgcttggatggcagtcctgtacggataagggcagttttacccgtgcaattttagatgcacttgctgaggaatatcattttgatttggaaactccgtttcaggattattcggatgaaattaaagacgtgattctcaatggaacaggtggaaagaaagtgaaagtttattataaaggtcagcgtggagaaggcatttatgatgttgcttttgaggggcttatcaaaaacgtggagcgtcggtatagagaaaccggttcagagagttccaaacaggaatatgaaagtttcatgcagattacaccgtgcaagacctgtaaaggtcagcgcctgaaaaaagaagcgcttgccgtaacagtcggagagaaaaatatttccgaggtaacggcacttttgattcgtaatcttcaggaatttttggaaaatttaaagcttacagagacacagcagttagtcggaaatcaggtgttaaaagaaattcgtgcaagggttggttttcttgtgagtgtaggtttagaatatctgacgctttcaagagcgaccggaacactttccggaggagaggcacagagaattcgtctggcaacccagattggttcggggcttgtcggggttgcctatatcctggatgaaccgagtattggactgcaccagagagataatgacaggctgttatccgctttgaagcatttgagagatttaggaaatacgctgattgtggtcgaacatgatgaagatacgatgagggaagccgactgcattgttgatattggacctggtgcaggagaacatggaggagagctggttgcaattggaactgcagaagaaattatgcagtgtccggaatcaattactggaaaatatttgagtggtgaattaaagattccggttccaaaggagagaaaacagccgacgggatttttgactgtaagaggcgcagaggaaaataatttaaaaaatatagatgtcaatttcccattgggggttatgacctgtgtaaccggagtatcaggttctggaaagagttcgcttgtcaacgaaattttgtataagagtcttgcaaaaaaattaaatcgtgcaagagtagtggcaggaaaacataaatgcatcgaaggagtggaacaacttgataaggtcattgcgattgaccagtccccaatcggacgaactccaaggtcaaatcctgcaacgtatacaggagtatttgaccagattcgtgatttatttgcggcaactgcggatgcaaaagcgagaggttataagaaaggtcgtttcagctttaatgtaaaagggggacgctgtgaggcatgtagtggagatggaatcttaaaaattgagatgcattttcttccggacgtttatgtgccttgcgaagtgtgtcatgggaaacgttacaaccgtgagactttggaagtcaaatacaagggaaaaagcatttatgatgtgttaaatatgacggtggaagaagcactggaattttttgaacatgtaccgtctatcaaaagaaagattcagaccctttatgatgtaggactttcttatatccgcttaggacagccttctacggagctttccggaggtgaagcacagagaatcaagctggcttctgagttaagcaaaagaagtaccggaaagacgatttatatcttagatgagccgacaaccggacttcattttgcagacgtgcataaattaatcgaaattttacagcgtctttgtgaaggaggaaataccgttgttgtcattgaacataatttagatgtcataaaaactgcggattatcttatcgatattggtccggaaggaggggataacgggggaactgtggtggcatttggaacaccggaagaagttgcagcgaatcctgtctcctatacaggtcagtacgtgtcaaaatatttgaaatgattgcctcttttcatttttcggtaagttcggtataatgaaacacacagcagtcaggctgtggtctgccagaatcttaaaataagatgaaaataaaaggcaggaaaggggtaaaaatatgggagctacagagattggaattgacttgggcacagcgaacattctggtatatgtaaaaggaaaaggaatcatattaaaagagccatccgttgttgcttatgataaagatacaaataaaatacgtgcagtcggcgaagaggcaagacagatgattggaagaacaccggggaacattatggcgatacgtccgatgcgtcagggtgtgatttcagactatgaagtaacagaaaagatgctcaaatactttatttcaaaggcaatgggaaaaagagcgtttcgaaaaccaagagtcagcatttgtgtgccaagcagtgtcacagaagtagaaaaaaaagcagtagaagaggcaacttatcgtgccggtgcaagagacgttgcaatcatcgaagaaccgattgcagcggcgattggagctggaattgatattacaattccatttggaaatatgattgtagatatcggaggaggaacaacagacgttgcagtaatttcgctgggcggaacggtagtttcaacttccataaaagtagcaggagataactttgatgaggcaattatgcgttatgttcgcaaaaactataatttgattattggtgagcgtacagcagaggcagcaaagataaagataggaacggtttatccggaaactcttccacatacaatagaagtaaagggcagagatactgtatccggacttccaaaaagtgcagagatttcatccgaagaaatccgtgaggcacttgcagaatgtatcgctcagattatggaagtgattcacagtgtccttgagaaaacaccgccggaactggctgcggatgttgctgaacgtggaattgtcttaactggaggcggggcgcttttgggtggattcgaaaaattgattgaagaagaaacaggaattaatacagttgttgcagaagaccctggaatggtagtggctgttggaacaggacagtaccttgatgtaatgagtaaagtcgagggaaaataagaaaggaaagcagatggaggaaaccatagaaggatacgttgaccacattatctttcgaaatcaggataatggatatacggttatggtggtagtcacagaggacgaagaattaacttgtgtcggcagttttcagtatatgaacgagggagaaacgataaaagcgttcgggcattataccgaacatccctcctatggacggcagtttgtaatgagttcttatgaagtcattgttccacaggattctcaggcgatggagcggtatttggcttcgggagcagttaagggaattggagcggcactggcagcaagaattgtccgcagatttaaagaagacaccctgcgtattatggaggaagaaccggaacgccttgccgaggtaaaaggaatcagtttgagaaaagcgcaggagatttcagatcagatagtggaaaaatcagatatgcgaaaagcaatgatgtttcttcagcagtatggaatttctctggcacttggaggaaaaatttacaagcagtatggaccacagatgtatcatgttttaaaagaaaatccatatcagatggcagaagatgtagaggggatcggatttaagattgcagatgagattgcaggaagaattggaattttaccggattcagattatcgaatccgaagcggacttctttacatactgacgcaggcatcggcagagggtcatgtttatcttccaaagaagcttcttttaagaagggcatctgcgcttttgtgtgtggaagaatcctacatggaaaaacatatcatggatttggcaattgagcggaaggttgtaataaaagaaattatgccgggggaagaagaacaggagcagattgtgtatgcaagccagttttatcaggtagagctgcatgtggcacagatgttaaaagaactggatttaaaagaagaaatcaatcaggataagttaaagcttcagttagatgaacttgaatcagcagaagaaattacgctggatgaaaaacagagacaagcagtaatgcaggcagcctcaaatgggctgcttgttgtaacaggtggaccgggaaccggaaagacaacgactattaatgcgattatccggtattttgaacaacagaatgaagaaattcttttagctgcgccgacgggaagggcggcaaagcgaatggcggagacgacggggtatgaggcaaaaactattcaccgtctgttggagctttccggtatgccggagaatcagacaaaaaaaggaattcattttgaaagaaatgcgcagaatccattagaagccgatgtgattattattgatgagatgtcgatggtagatatttttttaatgcatgctctgctttcggcgattatgccgggaacaagactgattttggtaggagatgtcaatcagcttccaagcgtgggcgcagggagcgtgttgaaagatattattttgtccggtcagtttgccgtggtagaattgacaaaaattttccgtcaggcttcccagagtgatatcgttgttaatgcgcataaaatcaataagggaataccggttacactcgataataagagcatggactttttctttttaaaacgttacgatgcaaacgtgattatccgtgtattgatagcgctgattcagaataaactaccgaaatttgtaaatgcgactccttatgaaattcaagttctgactccaatgagaaaaggacttttaggtgtggaacgcttaaatatggttttacagcagtatttaaatccgccagataatcagaaaagagaaaaagagcacagacagggactgtttcgtgaaggcgataaggtcatgcagattaaaaataactatcagacagagtgggaaatccgtggaatcgggggcatccgtattgaaaaaggtgtaggtgtatttaatggagacaccggaattatcagagaaatcaatctgtttgcggagacgctgacggtcgaatttgaagagagacgttttgtagaatatccatttaggcagttagatgaacttgaacttgcttatgcaattacgatacataagtcacaaggtagtgaatatccggcagtagtcattccgcttttgaatggaccaaagatgttaatgaaccgtaacttattatatacagcagtgaccagagcacgaaaatgtgtgactttagtaggagatgaaaaaatattctgggaaatggaagaaaaccaaatggaacaaagccgttacacgacactcgatttaagattaaaggaaatcggattacagcaggaattttagatattctttatccaaggaggtgtccggtgtgcggagaaatcgtagcacaaagggggcgcagtatctgtaaagactgcgccccaatgttaaaaccgataaaaggagttcgatgttaccgctgttccagaccacttttagaggaacgacaggaattttgctatgactgtagtagaaaaaaacatgtttatcaacagggaattgcggtgtttgggtatcaaagtccggtggcgcagtccctttatcagttaaaatatcatgcgagaaaagagtatggaattttttatgggcattatgcggcagtgtatgcaaaaaaacaaattcaggcatggaagattgaggtactgattccggtgccgctgcatccgtcccgtttggcaaaacgtggttataaccaggcagaggtgattgcaagggcgatgggagaaaaattaaatcttccggttgtgacggatgcagtaaaacgagtggaaaaaacaaaaccgttaaaggaattaaatccacaggagcgcagaaaaagtcttcagagggcatttatgccggcaaaaaatcaggcgcactggaaaaatgtactgattatcgatgatatttatacaacgggaagtacgattgatgcagtcagtcgggttttaaaagaaacacaaagagcagaagctatctattttctgacgatagcaatcggtattggaaataattagaaaataatcagaaagaaattgacaaaaaatttttcatagaatataatggggcaagaatcgggaggtaaatcattttgtttcataagtcagcacagtgagtacttttacaggagctgtgctttagaaaagaggagtaaaaatgagaaaaaaaacattgtttatcgtactatgtctgctttcaggaattctgactcttggtggatgtggaaagtcagaaactgatgatgccaaaacacagaaaagtgaagcaaaagaagaggatgaatgggaagaaactccggttgcaccaattgaaaaagaagatttgaaaaaaatcggagttccgctgaaggggactgttgagataaaactggaaaataatactggaaagagtattaccggatttgcagttaagaaaagtgaaaacagtgagtttggtgagaacctgctcgaagatgaggatgtttatgtcaaaggtgagaagcgttatttttactatgactataagcaggaaaattcagaagaagaaacggagacgatttctgcagattacgacggtaatacagaggaagaaacagacgaaagtgtacctgaatatgatattcagattacatacttaaatggtaccaccgcagttcttcataattttccgtttgatgatatgaaagagggtacattagagttggaagatgagattacttatctgacttatacaagtatcaagacgaaaaaagaagtcgatacaaaagacgaagagcgcagtatcaggacaaaagaagaaacagcagcggcagaagcgcagagaaaagcgaacgaggcggcagcagcagaggcaaaacgtcaggcagcggaggcggcagcagcaaaacagcaggcagaagcagcggcggcggaagcacaaaaacaggcgcaggcagcagcagaggcacagaagcaggcacaagagcaggcggtacaacagcagcaggatgcaaaccagaatcagaatcaggatgcaaaccagaaccaggacgcaaaccagaatcagaatcaggatgcaaaccagaatcagaaccaggatgcaaaccagaatcagaaccaggatgcaaaccagaatcagaatcaggatgcaaaccagaatcagcagacgcctgataatacaacgacagatagtaatacaacaacagaaactcagcaataagaatcaaaagaaatgaaataaagaaaaaacagataaaagagaccattgaaaagagaaatgttactaagaacaaagagaacagtaacaaagaaacaatggtctcttttggtatgcgcagaaagggttgcttcgtctgctttaagtatggtataatataaaacgtatgattagatttgctttaagaaagcagagggaaattagatgttaaatgaacagaaaattaagaagatgagaaagctggccacctatgagtcaggcaagggtcgtaagcagcttagaatcagtaagtattatagaagtgattatatcgggctttccttgattaagaatttttttcttactacaattgcttatggtttgctgcttctggtgtatttcggaagcaaaagtgattatctgatggataatatcaatcagatagacgtggttgcactcggggtgaaagtaattttgttttatctggttatgattgcaggatacagtattattacctatgtgtattgttctgtaaagtacagacaggcacaggagggggtagaggagtactatcaggaattaagccagcttaaaaagatgtatgacagagaagaaacaaaagctggtaaagcggctaaaaggaggaaggcataaggcatgacgaaactattactatggaaacaaaaagtgaaagaattttatggagagcatgatttctggattacgcctttatttaaattccttttggcatttgttgtattttcacagattaacggtttattaggatttatgagacaaatcgataacatttttgttgttttgattttatctttgatttgtgcaatgttttcaattaatgtgatgaccatattggcgtgtctcctgattcttggtcattgttatgcagttggaattgagacggcaggatttgcagcagtcttactgattttattactgattttatttcttcgttttacttcagaagataatgtcgcattgattcttacaccgatttcttttaccctgcatattccggcagcagtaccggtaggctgtggcattttaagaggagcatcaagcgcagtaccatccggatgtggggtaatattatatttctttatgaaactggtaaaagacagagcaacggtacttcagggaaatgaaacggagccactgcagaaattacagcttttattagacggtgtcttaaaaaatgaagaaatgtggctgacagttgtagtttttgcagcagttgttgtgattgtaagtgtcatcagcagagcgtcttttgactatgcatggagaattgcaattgtgacaggtgcagttgtttatatcgttatcatggtatttggaagcatgttcatgagcgtcagcacggaacttgcagggattattttatctggtgtagctgcaattattattggatttgttattgaattctttgaactgggtgtggattattcaagaacagaactgactcagtttgaagatgatgaatatatctattatgtaaaagcagttccaaaagcactggtttccgaaagcaaaaaaagtgtaaagaaatttacaccgaattctaaagtggtggaagaagtaaggctggatgaagtcagacaaaataaagaaacaaaagcgtatcagcaggaaagtcagcatcaggaaataaaaccaattccggaagaaaatctgagtcagaccgaaaaagcacatacacaggatttttcagcgaaacagaacacagcacaggaagaatcggaggcagttccggtagaacgtgtggcagaagaagattttgactttgaaaaacaattagaggagtctttaaaaaacttataaaaatttcagattagagaaaagaactataagggggtgagactgtgggagattttttattatccgtaacaagttacttaacaggtatccgattaccgtattttacgtggagtgatattgttgaaattctgttgattgctttctttgtatatgagtttatgttatggattcgtaataccagagcatattcgcttttaaaaggaatcttaattgtgcttgcatttattttcattgcatttttattgaagatgaatacaattttatggctggttaccaacatggcaggatatgcaattacggccgtattgattatttttcagccagagcttagaaaggcacttgaagaactgggacataaaaaaatcgtaagcagtatcattccatttgattcaggaaacaaagaagaagacggatatttttctgataaaacaattaacgaaattgttcgtgcaagttttgaaatgggagcagtcaaaacaggagctttgattgtaatagaagaagaaaccattttaaatgaatatgcgagaaccggaatttatctggattctttagtaagcagtcagcttttgattaatatttttgaacataatacaccgcttcacgacggagcaattgtcattcggggagacagaattgtggcagcgacctgttatctccctctttctgataacatggcactgaataagaatcttggaacaagacatcgtgcaggagtcggaatcagtgaggtcagcgattcttttacaattattgtatcagaagagaccggaaatgtatcagttgcaaaacagggcaaactggatgttgcattgacaaaggatgagttaaaagaacgtctgaagaaagagcagaatgcgacaccggagaatgcaaaacggaaaaaaataatatggaagggatggggaaagaatgagaaaaaatctgatgaataaatttactcttagaattctttcgctgtttattgccatatttatttggcttctggttgttaatattgaggatcctgtaaggacaattacaattaccgatgtaccggttacatttgcaaacgaatcttatattgaaagcatgaataaagtggcgcttatggaagatgggaaagatactgtggatgtcaaggtgacaggtgcaagttcgattatgaaaaaaatcagcagggacaatatttcagcggtagcggatttaacccagattgtagatctggagtctgatccgattatggttccggtctatgtcagctattccggtattgaagagcacaacatagaagcaagaccaagaaatattccgattacaattgaaaacagagtcagtcaggaatatacaattgcagtgaatacaggcgatacgaaaccggaaaaaggatatgaagtcggaaaaacggaaacaaatccagaccgtgtgacaatcatcggaccagaatcgattatgaataagattggaaatgtcgtggctcaggtagatgtcagtggaatgtcaaaggatgataccagacagtctgagattaaagtttatgacaaaaacctcgaagaactttctgaaaagcagatgtcgtatctgaagtttgatatacagtctacaacaatagatgtaaatgttgaattatggaaagtgaaacaggatgttccggtggaagtgaaatattccggaacggtaaaagcgggatattatgtattccaggtttcttctacgccgaataccatcagtattgcaggaacgcaggaagccttaaaacagtttgaagaggatggagataaactggtaattccagcatcactggttaatatcagtggaaaatcttcggattatgaagtaaaagtaaatctcgaagatttgcttccggaagatattgaacttgcgacagatatcagtgagacagcccttgtgacagtgaagattcttccgttaaatagtaaagagtatgaaattccggtaaacagtatcacagtaaataataagccatccgatacggatttggtttttgacagagagaaaataacagtaagaattctgggaacggaagaagcacttgaaaatctgaaagaagcgcagattgcgttaagtattgatttaaaatcttacggtgtcggagaatatgaagttccggtacagattacacttccggatggatatacctctctggatacggtgaaagtaaaattaaaactggtgaaagccgcagaaattacgacgggatagtggactttgaacacagatttacaataacagaagcagggagtgagaaacatggtaagccagaaagtaaaagtaaataatttgattggtctgcacttaagaccggcaggaaagctttgtaatgaggcaatgaaatataagtgtctgattacctttcattataaagacgtgacagcaaatgcaaagagtgtgctgagcgtacttggtgcctgcgtaagaggtggagcggtcattgaactggtatgtgagggagaggacgaacagaccgctttggaacatttggttgatttgctggagcattcacttcaggagtgaaccaccacacgccataaaggcatgtggatacacggcgacagaaacttataaagaaaaataagaatagaaatacaaaagtgctggggcaaaaattttgaccccagcattgtgctgtaattatgataaaaaagaaaaaatacaaaatgggggataaacatgcagaataatataaaacaaggcttaaaagatggaattccgattgcacttgggtatttttctgtcagttttacatttggtatgctggcagtgaatcatggaatgaaaccatttcatgcagtattgatttcactgttgaatctgacatcggcaggacagtttgcaggacttaatgtcattctggcagggtcttctctggtggaaatggcactaacccagcttgtcattaatatgcgttatgcgttgatgtcactgtcactttcacagaaatttgcacgaagtgttcataccggacacagactggcgattgcttatggtatcacggatgaaatttttgcggtggcgagttctaaaaaaggaaaagtgggtcagtggtacatgtatggattgattttccttccggtggttggttgggtatccggaacgcttggaggtgcggtggcaagtacaattatgccggaatttatcagaagtgcattgggtgttgctttatacggaatgtttgtggcgattgtcattcctccggctaaaaaagagaaaaatgtaggtattgttgtaattaccgcattgattttaagtacaggattttattatctgcctctgctttgtaagatttcagatgggtttaaaattattatctgtacgttattagcagctggaatgggcgcagtcctgtttccgattagggaggaagaatcatgatttatgcttatatttttgtgatggcaggagtaacgtatctgattcgtatgcttccgctcacattatttcagaaaaaaattacaaatgtttatatccgttcgtttttatattatgtaccttatgcctgtctgaccgctatgacgtttccggcaattttgtatgcgacagattctccaatttcagcgtttgcggggctggtagttgcagtgattttcgccctgaaagaaaaaagtcttgtaacagtagcgtgtttctcttgcatagctgtgtttgttatggagagaattttatcatttctgtaaagaaaacttaatattgttttacattctgtttgttgtaaaaacaggtcaaaaatggtaaaataagtaaaaatcaggagataccaggaagcgagggataggtatgaaaaaaagaagaatgaaactgttatccttgatgcttaccgtggccgttactatgacaacggtattgccggtaagtgcagcgactgtatcagaaggagcggtacagagccaggaaagttcacaaactcttttagagggacaaccggatggcggacagcaggaagttggagagcaagagacaggagaagaaactccggatgtgaaagaaactccagatgtgaaagaaactccggatgtgaaagaaactccggatgcagaagctgaggctccgtctgaggatatgaaagaagagccgaatgagactccggcggatgaggcaaagacagaagaaccttcacaggaggaactggaagaacgacagccgacggatacaattactgtactgaaaaataatgaattaaaaggtgaaaaaattgatgaacactggacgttagaaactgtagtggatgcatctaataaagcaaaacagataatttatcgttattatgaaaatcttacaaatgcagacacgctgacagaaaaatgggtgtttgaagtagaaaaaagtatctggataaaatatgaggctgaaactgatgtaacaccggttgttttaagtgaagatgtttatcagattggaaaagacagttattatttaaatgcaaagggtcaatttgcatccaacgcatggaaaaaatatagaagtgaaaccggaacagagtattattattattttaatgcagaaggaaagaaagatgcttctaaaacaggactccgtacagatattgaaaatggagtaacttattttctggaagaaaatggagagatttttaaaaatggtcagaaagtcataaatggagtgacttatgtctttggagcagacggaaaatgtacttccaattataaaccgggctgggaaaagacagctgatggttggaaatggaaacaggctgatggaacatatgcggcaggtacctggattttgacaagtggtaaatattactatctgaaatcgaacggaatcatggctacctactggacacaggtagatggaaaatactatttccttggcgcagatggttctatgagaacttactggcagaatatttatggtaaatattattggctcggaagagatggagcaatgaaaaccggctggcagcaggtttatggcaaatggtactatcttggaaaagaaaatgatggtgcgatgaaatattactggcagaaaattgacggtaagtattattggttaggtcatggaaatgatggcgcgatgaaaacctactggcagaaaatctatggaaaatattatttccttggcagtgacggctctatgagaaccggttggcagaagatttatggaaaatactattatcttggcggagcaagtgatggctctatgaaaaccggttggcagaaaatcggaaataaaaagtattattttggcggagcaaacgacggtgtcatgaaaaccggctggcagaagattgatggcaaatattatcatttcggaggtactgcagacggagcaatgaaaaccggttggacttctgttggcagcaaatggtactacttagacagtaacggagtgatgcagactggttatattaaaaccggaaataccagattttatatggatgcgaatggtgttatgcagaccggctggcagtatgtcaatggatataaattatactttaaatccaatggagcattgcagcaggatgtcagcagtatggtaagcggaccatacagactgcgtgtaaatcgtacgacctgcatggttactgtatttgcaaaagatggttcaaacggatatattattccggttaaatcaatgacctgctctgtaggacttccggcaacaccaaccccaacaggaacattctacattggtgaccaggacagatggcatatcttaatgggtccatcctggggtcagtatacgtctcatgtatatcagggaatctttattcactctgtagcaggtggacggcagaacatttataacttaaatgcagcagattacaataacttaggacgtccggcatctcacggatgtatccgactttgtgtaagagatgcaaaatggatttatacaaatgtaagcagaggttcacagattacaattggtgatggctattatgagccatttgataaaccggctacgattaaacttgcaccgggaacaaatcttatggacccgacccagtgttaagcagataccgactaaagaaaattttgtttttagattttgcttaaaaaagaagagaggcgtgtttttttgacacgtctcttcttttcgcttataatgtatagaaaggtacgattgagaggcgaaaaaaatggaattggaaagaacaccaatttatgagatttttgacagaaaacagtcgggaaatcagctctatatcatgagagaagatttactgccattttcacttggaggaaataaagtaagaattgcaaatgccttttttgaagatatgcagaaaaaaggttgtgatattatgattgcttatggaaatgtgcgatctaatttatgcagggtgattgcaaacgaatgtttcagaaaaaagattccctgttatatgatttgttcatttgaagagggcgaaagtgaggaaaaagagacaagcaacagccatttgatgcagatgcttaaggtaaaaattgtaaaatgtagaaaaaatcagattgcagagacagtagaggcaacgatgaatcggttaatacaggaaggacacaaaccgtattatatctatggaaataaatttggaaccggaaacgagggggtttctgcttctgcttatgcaaaagcttatcaggagatcttgaattttgagaaaaaccaagggattttctttgattatatttttcatgcatcgggaacaggagcaacacaggcaggtctgacttgtggacatcttttggcgagagataagaagcagattgttgggattttgatttcctcaagagagtatgaacgtgcggtttcgattattgaaaccggaatgagagaatacttaaaagggcttggaaaagagttttccatggaagaccaaaaagagatccatctggcaagtgagtatacaaaaggtggatatggacagtatgatgaggaaatcgagcagtgtatccgtgaggagtttgccttaaatggagtggcaatggatggaacttataccggaaaagcatttcttggaatggaacactatatcgaagattatcagatttctggaaaaaagatattattcattcataccggaggaacacctcttttctatgactggcttggtacacaaaaaaaagatttaggaaggttataagaaaaatgctgatttctattgtaataccttgttattattcggaaaaaacaattcagaaagtagtcgagctgacgattcaggaatttcatgcacataaaaaatatcaatgcgagtttgtcctggtaaatgatggatcgacagatggaacgtttgaaaaaataaaagaattagcaaagaaatatccatttgtgcatggagtcaatctgattcgtaactttggacagcataatgcactgatggcggcacttcattatacaaaaggtgattatgtactcggaatggatgatgatatgcagacgcatccttcacagatttttaagctggtagagaaaattcaagagggatatgatctggtttatggacattatggaaaacgaaaaaattcttctctcaagaacttaagcagtaaattaaatgaagtttcttcgagaattttactgggacggccaaaagaaattacttcaagtaatttttggattatcaccaaaaaagtagcagaagaaaccaggaaatatgacagttataatccttatattgatgggattttttatcggattacccacaatattggaaatgtggaagtggaacatcataaaagagaagttggagcatctaattataccctgcataagctgattcatttatggctggcatattggaattattctgtaatcccgcttcgaatttcgtctgtggcaggtggaattgctgccggagtcggatttttgatggcagttatcacagcgatacgaaaaatcgttgacccgtctctggtgattggctgggcgtctatgatgtgtgtgacgatggtatttgcaggcatgattttaatgtgtcttgggattgtcggggaatatcttggaaaaattattcttacgctgaatcatactccacagtttattgtaagagaaacgataaatgtaagcgaacaaagggaagaaatttgaccgaatcaagaaagttggcaaatcagctaaatgggagttattttgaaatgtcaaagaagaaattaatgatattaggagcaggaatctatcaagtgcctttaataaaaaaagcaaaagaaatggggctggaaacgctggttgtaagcataaaaggaaattatccgggaattgcgcttgcggattctttttatgagatagatacaagagattatgaaaaaattttagaaaccgcaaaaagagaaaagatttccggaatctgtacctcaggaacggacgtggcagtgcgtgcgattggttttgtctgtgataatctgggactacgagggattccaagagaagcagcgtggaaggtcacggataagcttttgatgaaagaggcattaaaggcaggaggggtatcaaccgcagattttagaaaggtcgcttcttatgaagaatgtgttgagtcggctaatgcacttggatttccggttatggtaaaagcagtggacagttcaggaagccgtggaatccaccgtgcagacaggatggaagaattagaatatgcctggcaggaagcaaaaaaggtaacaaagaagccgtatgtgctggtagaagaatttattgaagccgatgaaataggggtagatgcttttattggagaagaaaaaatagaagcattttttccacatgaaaaatttacttatacggtaaatggaacaacgatgccaatcggacataaatttccttatcatgcatcgaaaaaactgatggaaaatctgaaacatcagattgagcttgccataaaagcactgggaatgaaaaactgtccgctaaatgccgatgtatttgtaagaggagagcaggtctggctgattgaagttggaggaagaacaggagcaacctgtattccggagctgatttcaatttatacgggttatgactggtatgaaaagataatcagttatgcacttggcgaagaggcagagtttcagagtgaagaaacacatccttgtatgggcgcattgctgttttcgaatcaggatggcataatcgaaaagattgaaatggataaacttaaaagcctggttcaaaaaggtattgaggttcagcttgattatcaggtcggtgataaaattgaggcaatgaagaatggaacagatcggattgggcaggtcattatgaggacaggaagcgaagcggaattagaagaagcgttaagccatgcaagagaagcagtctggctgtcgaaaggaaatttggaagaacgatggaaaaattaaaagattatatcttactgcatttaaatatcatgctgttttcatttaccagtgtattcagcaaactggcatcacagcagtttaataaacacggactgttttcagcaggaatgattggattttcttttttgatgttattaaactgctttgtttatgcaatcgcgtggcagaaggttatcaaaaaatttgatttaaatgttgcttatgcaaaccgtacggtatatttaatctggagccagatatgggctgtttttatttttcatgaaagtcttacagtgacaaatatgattggtttgctggttgtctttattggagtgttggtggtgcagaaatatgaataattatatgtggctgttatttatcggaacatttttcagtgcattctcacagctgttattaaagcagagtgcaaataaaacctataaaaatccgatttttgaatatttaaattggcgcgtgattctttcttacggaatttttgcagccgttttgtttctaaatacttatgcgtatacaaaagtagacatgaaatatggtgcagtaattgatacctttacttatgtgtttgttatggtattgtcgtattttattttaaaagaaaagtttacaaaggaaaaattaattggaaatttgattattatgagtggagtgtttatttataccctgccgttttaatcttccaaagaagaagccgattatgagatgtataaatataagaaacggatttatagagacagagtataaaagagtggaacagattgtagatttggcaaaatgttccactcttttaaaatttttaccggttgaagtaatcaaaaattgttttaacaacatattctttatccgcttgtgacagctggtagtacatcggaagacgtaccagacgttcactttcttttgttgtatagcggtcttctccaaagaaacgtccgtatttttttccggctggtgcagaatgtaatggaatataatgaaaaacagacatcacaccgtgttctcttaaataatgaataaaatcagagcgactttccaggttcgggagtttgatatagtacatgtgagcattgtgaatacaatcttttggaataaaaggctgttcaatcaattccttatcggcaagtggttttaatgcttcattataaaagttccaggtggccatgcggtcattttgaatgtcatctgccatttcaagctgagcccaaagataagcagcatttaaatcgcttggaagataggaagaaccataatcctgccaggtatacttatcaatctgtccacggaaaaatttactgcggtctgttcccttctcacgcagaatttctgctttttcctgataagcattattctgaaagaataatgcaccgccttctcccatacttaaatttttggtttcatgaaaactaagacagccaaaatctccaattgttccaagactttttcccttataataagaagcgaatccctgtgcggcatcctcgacaacttttaagtgatgacgctttgcaatattcatgattgtgtccatatcgcaggcaactccggcataatgaaccggaacaatcacttttgttttttcagtgatggcgtcctcgatcaatgtttcatcaagattcatggtatcaggacgaatatcgacaaagacaagggatgcacctctttgaacaaaagcatctgctgtggaaacaaaggtgtaggagggaaggatgacttcatcccccggttttacaccgcttaagacagctgccatttcaagtgcatgagtgcaggacgtggtgagaaatgcctgattggtataaaaatgttctttcatccactgactgcattttttggtaaatgttccatctccgcagatttttccgcttgcgatggcttcttgtatgtattttacttcatttcccgtatgaggggcaatattaaaatcaatcataacgactcctaaaaattttgttctaaatcaaataactacggtaacattttaacatagttaaaaaaaaacgcaaatattaatttgatatacattgcaatttaaaaataagtattatataataggaaatacttggttaacatatatgtaataaatttggaaaaagttgacgcaaagcaaaaagggaagggtaggaaatgaaaaaggcaacaaaaaaatggattgcttacttgttgacactgacaatgctattatctgtagcgactccggtattcggagcagagccagggacagaagaggctgtgccggaaactgtgcagacacaggaagcggtgcaaagtacagaaaaaagcgcagatgaaatttcacaggaacaggtttcggaggaacaaaattcggaggcacagagtacaaacgaacaggatacggaagagcagaattcgaaaacttctgatttagaaggaacaaattcggaagaaacaaattcagaagaaatgaattcagaagaaataaattcccgggatgctgtttcagaagtggcgtttaactatgtggttactcaggatgatggaatcaatcagtctgttattatgagctttggagacgaaacaacagtgattgagagtgcagtacttacataccgtgacggaggagagataaaaacagcagagtcagatactgtagcagagaactttgccgtttttttgcttccgattgcacaggatggagtggaacgtgtatgggaaagtgctgtagtgagaattacagggattgagtatactgtgtcacttcaagattctgaaggtatgacgcagacagaagtttcagaagaaaccgcttcagaagtattgcaggatacagaagagtctttagatgaagagactgttaatctggtagaagattctatcatttccacaaagggagacggaattacgggagaggaaattgcggattcaattgaaaaatcaatagaactcgttccggatgcagacgtaacagctcaaatcagcacattttccatggagtctgtgggaagagcagcacagaagtatgtgattgtgttagacccaggacatggtggttatgatggaggggctgaaaatcaaaatggaatttcttccgaatctgaatcaaagttgacattaaaaattgcaaattatgtaaaacaggagttagagaaatcatcacagtttgttgtctatatgaccagaacggatgacagctatgttgggttaagtgaacgtgtaaattatgcggcatccaagaatgcagatattttagtaagcctgcatttaaattccgcagattcaaaaaccgcaaatggagcagaaatccttgtaccaagaacaggacgctataactctaaggttgcggaaaatgccggacaactggcacaggatattttgaaaaaactggtaagtttaggcttatacaatcgtggactggtttatcgtgacagtgcaagtggtacaaaatatccggatggaagtaccgcagattattatgcaattgttcgtcagggattgcaggcaggaattccatccattattgtggagcatgcatttatcagcagtacagtggatgcaaagtttttagacagtgaagcagatttacagaagattggaagagccgatgcagaaggaattgcacagtattttggtgtgacactttcgaattcttctaataataacagtaatagtaattccagcaattcagacaagaatggctgggtcaaagaaaatagaaactggtattactataagtcaaatgcaaaacagacaggctggcagaaggttgatggaaagtggtattatctgaaggcaaacggagtgatgcaaacttactggtatctggaaaatggaaagtattatttccttggagcaaatggctctgtaagaaccggctggcagaatatctggggaaaatggtattattttgacagtgatggagtgatgcagaccggttggcagaagataaaaggagtctggtactatcttggagggtcttcggatggagcaatgaaaacaggctggcagaagattaatggaaagtggtattacttaaaggcaaacggagtgatgcaaacttactggtatctggaaaatggaaagtattatttccttggagcaaatggttccgtaagaaccggctggcagaatatctggggcaaatattatcattttgacagtgatggagtgatgcagaccggctggcagaaaatcgatggagcatggtattattttggaaatgagaaaaatggtgcaatgcaggtgggctggcagatagttgaccatgagtactattacatcgtggacagcggggtgatgcaaacttactggagaaaaatcgacggaaactactatttctttggagcaaatggtgtcagaagaaccggttggcagaaaatctggggaaaatggtactatctggatgaaaatggagtgatgcagaccggctggcagaagataaaaggagtctggtactactttggcgggtcttcagatggagcaatgaaaaccggctggcagaccattaatggaaagacctattattttgactcagaaggagcaatggcaaccggaaccgttacaattggcggaacaaagtatgaatttaacagcagtggagctctaaaagaagaaacaaaaaatgaagggttatatcagattacgggaacaagcagtgtgactgtttctcagatggtaaaatattataatacatactcttcgattgcttatccgtctgcagcgctgaccaagggtggtgcagcggatattgaaacattttgtaaaataataaaagaagaagccgatgcagaaaacatgaaagccgatgtagtatttattcaggcaatgttagaaaccggatatctgaaatttggcggagatgtaaaaatcagccagtttaatttcgcaggacttggagcaaccggaaacggagttgcaggaaattcttttaaggatgtaagaaccggaatccgtgctcaggtacagcatttaaaagcttatgccaataaagaggcgttaaaaaatacctgtgtagatgttcgtttctcttatgtgacaagaggaagtgcaccttacgtggaatggcttggaattcaggaaaacccaaatgggggcggttgggctgcaagcaagaattacggtaatgatttactgggattaattaacaagttaaaagcaatttaaaaaaacagacaggatgatgtcaaaatcctgtctgtttttttgctgtatttagatttaattagaacccatcagttctccggaagcagagaaaacataccattttttgtcgattaatttcagtccggtctgcatcactccggattcgtccagataataggttttgccgtttgaggtaacccatccggtctgtaacactccactataatttgcataataccatttgccgtcaacagagaaccagtatttctgcatcactccggttaaaggcataaggtaataacgattcttgccgtttgtataccagccttctatgcgtgcaccatttgactggagaagataccagttattgtcaattttctgccatccggtcagcattgctccagaggaatttaagtaataccatttgccccagatgctctgccatccggttcgcatgataccgtctgaaccaaggaagtagtaggcattattgactttctgccagtaggttttcatagctccgtcatttgcattgccaaagtaataccatttagaatcgagtcgtttccatccggtctgcatcagtccattagtttcaaaataataagttttgttattgagtgtctgccatccggtttttaaggttccgttctcatttaaataataccactggttggtaccgattttgatccatttggttttcattctaccgcttgttgggtcaaagtaataagttttgttgttaagtgtctgccatccggtctgcatgacaccgctcttatttaaataataagtctgggtatacagatacatccatccggtctgcatgataccattactgttcagataatgccagctgtttccaacttttacccatccggtctgcatgacacctttctcattcatgtaataccatttttgtctgtgataaagccatccggtctgcatcattccggatgaatttaaataataccatttatcatcgatttcacgccatccagtctgcatgattcctttttcattcatgtaataccagtattttccactttttacccatccggtctttaagattccggttgagaggtcgaaataataataagtttgattaagatacagccatccaatatgacgatatccggtggaatcaaaatagtatttttctccatcaatggtttcccatccattttttgtgtagcttccgtctgcgtgaacataccaccagccatttttatcctgtttccatccagttttggaggttgtggttttggaagtgtcccagactccgttttcatcaacataagatgttccaatccaggcattttttgccatggtgccgtctttctggaaataatagcattttttattgatccatttccacccagccgaaagcatctgaccgctgtcattgaaaaagtaagtatcctcatcaatggtgcagagtccggttgaaatactgccgtcattctttaagtaatagtaatagtttccattttttaaccagccatgaacgagtgcaccttttgcatcagcataataccaagttgcatttgtgcgaatccatttcttttcatctgcggtaatggaattagaaaaatgataggtttctccatcatagtccacaaaaccggtgtaggctttttcacgtccatttaaataactggaaagataaggcgtctcgtctttactgtaaaagaaataatcagaagaagagacatttaagtccagcgtatccatatccagtgtgattgcaggagtgtatgaagtatattctggaagagagtaaagtcttgttccaagtttatttaaaagttcaattctgtcttccggaagaaccttgtaaagccctgactgaatggcaattgttggacttaaggtatttagatattccagagagtttgaatttgcgattccatgatgacccagctttaagacatcaatatgtcccaaaactttggaaagacgtgcctcatctccatctgcaaaaccgatatcgccgctaagaaaggcagtgtatccactgtcggaagtgacttttacgccaagagaaaaatagttggcatcgagttttccggttgttttgtaatcatcactgtagttcatcacctgaagatgcaagtccccaaggtcgaagtctggatttccggttgtgcttgcaggtgtgctgtagactgttgagtttggatcagaagaattcagtacagcaattccttcttcggggaatgcctcttccattgcagggtcatcttcagaaaccggagaatctccatatttttcttcaatttcctgttctgtaatataagaataagaacgggtatccgtaccggcagaaatattttgttcttcggtctgagcggaagcttcagcagcctggtctggaacaaccggtgcattgacatcgaagttctgaatcaaagtacttccaacttctttcgctgcctcaactgctttatcgtaaacatagagattgtcaaataacagtccgggtgaagtgatgtattcatctttgtattccatcagatagactctttgaggatgaaattcccgaatgacttcatccgcagaaccgatgtggtcactgtgaggatgcgttccaagataaaaatcaaagttatcctgcgtgacaccaacactgtgcatgtaatcaagtacctgttgttcatagccctttccggtatagacattgtttcttagtggatagcgtgggtcactgccatccggataatcgctgtcttctccggagtcaatcattccaaagtgtccattgctttcaagcaggatggcatcactgttatacggaagagtgataaaatgaatttttgaataagaaacttccggttcttcttcgctgtcgtctttatcggatgaatctggattttgggtatcaccggaagaatccgaattatctggattctggatatcaccggaagaattcgaactatctggattctgggtattaccggaaaaattcgaaccgtccggattttgaatatcaccggaagaatccgaagaaccggatgaatttgacgaatctggattctgactgcttccggacgaatcggaagtatctgagtctttgagttcatcctcagaggatgatttcctggaatcagaggcatcttctgaagtgtttgaagagtcggcagattctaaagcggaactgccagatacagaggatgcagaaaccggaacagaaccaaatacagttgttgtgctaagcagcagtgccaggaatctggcaaaataaggtttctttttgtgcatagataatatccctttctattctatttgtatgcattgtttttgcgtcttatcctgctattataagctattttttgtcgaaaattcaatagttatgtagaatacaaagagagaaaaacgaaagagagacagattctggcatttgcttttatacaggaaatatagtaagatacttcgagagtggttaaaaaataaaaaatggaggtttaagatgcaggaaattacagagattgccgaattaaaagagatacagcttggaatcttaagaaaagtagatgaactgtgtaaggcacatcatctgaaatactttatgtctgatggaactctgcttggggcagtccggcataaaggatatattccgtgggatgatgaccttgatatatggatgccaagaaaagactatgagaaattagagcagattatgaatcaggaagactcctgctataaagtagtcaatcataaaaatacaaagggatatatttatgcctttggaaaagcggttgatactcgtacaattttaaaagaaaatatcgaagtcaattgtccaatgggaatttatgtagatatttttccttatgatggactccctggggagaaaaaagaggattatatcaaacatgtcagaaaatgtttgtatctggaaaaacagcgttacagagggtttcagagttttaaaggtgtaaaaggaaaccatactacaggaaatacaaaacggtttgtattctgggctgtcagaagactgattggcggaaagaattttatccgtatggtagaccatttaagtcagaagtatccggtagagggggcaaagtatgtgggctgtctggtgggcggttataaagaaaaagatatgatgccggccgaaattttttcagaagcagttgaattggaatttgagggcgaatatttccgtgcgccaaaaggctatgatacctatcttacaattgaatatggcgattatatgaccctgccaccggtagaacaacgtgtcacccatcatgattttaaagcatggtggaaaaccaaataaggagaattactgtgaagaatctttggaaatttgtaaaaacttcaggtatctattttataggtacagtattacataaattgattacgttcttcctgcttccgatttataccaaatatatcgacaaagcagatcttggaacgtatgaccttgcaactgcttacattaacttcttgtgttcgattctgtttctggatatctggagcggaatcatgcgttttgcctttgaatatgaaggagaagagcggaaaaagccgattaccagtggaattgcgattttcaccggttctacggtactttataccatcgtgttatttggagcaggatgtatctttgatatcaagtatcttccacttatctatctgtatggtattatgatgaacattcagactttagttggatatcttgcaagaacctatggaaaaaatgcgttatataccacatctggtctggtcagctcttttgtaactgtagcatgtaacattttatttattgtatatttccgcatggattacagtgcactgtttatctctgcctgtatcggatatctggtcaatatcgtagtgcttggatggggaatcaagctgccaaagctgatttctgtgtcagcctttgataaagatttattcaaaaggatgctgattttctcacttccgctttgcatgaattctgtggcatattggtttttaacttcctataaccgtgtcgcaatttcaaatgttttatcagtcagtgaaaatggtctgtattcgattgccggaagattttcttcgtttattacgttgtttacgacctgctttaatatggcatggcaggaaatgtcttattcaagagaagcacagaagcagacgaatcagggagaattttataccactgctttaaattcttatatcaagtttttatgtatggggcttttaatgctgattcctgcaatttcagttatcttcccgattatgattaatgaatcttatgcggacgcaaaacagttggtaccgtattatctgcttgcaaccattgtttcctgcatcagcagtttctttggaaatatctttactgcaattaagaaaaataatgtattgttttataccacagtggcaggaagtgtggtaaatgtagtcagcgtgcatctgctattaccgattgttggggtacagggagcaagtattgccctgtttttaggttttatggtaaataatacgattcgtgcttatctgctgaaaaaagaaattcaggtttcaatcgatttgaaattcattgttgcatgggcaattgtttacattggagtaagttatatttatctgcatgcaaatgccatcatcaatgtgttaactgtttttgtgggaggattgttgactttatttgtattccgtaaggaattaaaggagattttaggtacaataaaaaacagataaatgaagtaaatgttgaatcttcttgaacaaaatgttaagatgaatgttaagagactaagaatattaagaggttggatggatgaaaggtgtaaagagagaacaatttcggcgtttagtcagaagcatagccgtaatgattattctggtactggaatcttttattttttattatgtctggaataaatattacagcagggggctttggattgagccgttctatgcaaaaggaaatattttcattgtattggtgtatgcggcatttatgctgttgtttttatatatttatggtggatttaaaattggttatatcaaaagaggcaatctgatttattctcaggcattgtccggactttgtgccaatgtaattatgtatcttcagattgtgctgttataccgtcgtctgccggatgtgcgtcccttgcttgcaatgacgttggcagatttgcttgtaattggaatttgttcgtatttttttgataagctgttcagttatattttcccgccacgtgatattctgttgatttatggagagtatccggtggaaaaactgggtggaaaaattgcaacgagaaaagataaattccgtattaaagagcggatttctgtggatgaagattttgaaaccattcagaaaaaaattctggaatatgaaaatggtggtgtacttttaggagatattcattcctctgacagaaaccagattttaaagttttgttatgcacattcgattcgtgtgtatctgactccgaaagtttcagatatcattgtaagaaatggagaaacgcttcatttatttgacactccgcttttactgtgtcgtaattatggattaaatatcggtcagcgttttgcaaagaggactctggatttggtggtttctgttttgatgtttattgtggcatctccatttatgctggtgactgcaattgtaatcaaggcttatgacaaaggaccggttttgtttaaacagaaacgtttaaccattgatggaaaagaattttatgtctataaattcagaagtatgatagtagatgcagaaaaagatggtgtggcgcgccttgcaaaagcaggagacagcagaattacaccggttggaaaagtgattcgtgcaacacgattagacgaacttccacagcttttaaatatcatcaaaggtgatatgagtctggttggaccaagaccggagcgtccggaaattgcaaaagaatacgaaaaagaaattccggaatttgcgttccgtttaaaagtgaaggcaggattgaccggttatgcccagatttacggaaagtataataccacagcctatgacaaactaaaattagatatgatgtacattgaaagttattcgtttatcaatgatttgaaattgattttatctacctttaaaattatgtttatgaaagaaagcaccgaaggcatggaaggggaagaaacaattgccttaagccaccagcctgagaaagagaagaaaaatgattagtattattgttccggtgtataaccgtgaaaataaagtaggaagctgtattgcaagtattttaaatcagacgtacacggatttggaattgattttagttgatgatggttcaaccgataacagtgtggcggtctgtgaggaatatgcaaaacaggataagagaatccgcatcattcaaaaagaaaacggtggtgtcagcagtgcgagaaattgtggaatcaaagaggcaagaggagagtacttacagtttgttgattccgatgataccattgacaaagaaatgacgcagaaactttatgaggcggtacaaaaaaatgaggcagatgaagcaatctgtggatttcgtgaaattcatggcgggacaaggggggatgtgattcgcatccctcaaaaagaatgtgtgacgacagttgcaaagatggaatcggaaatcgaacatctgattttgaattgtctgcttcagtcctgctgtaataaactatataaaaaagaaaaaattaaagaatttttttcaaccgagtatacttatggtgaggatttgttatttaatcttgcctatttaagaaagattgaaacgattgcctttgttccgaaagcatattatgaatatgactgccgtggggagtcgattacttcttcttatcgagaagatgagattgagatacgaattcatttaatgagagaagtattcgcatttagcgaagcctgtctggaaggaacacaggtgatgcgcgagtttgctgataagaccatgcgggcggtcatttatagtttatttgatatttatcaggatgaacggttttccaaatcagaaagaaaacagaaaatacttggttatttaaagaatcagacggttcaaaaagcaagcggagtctgtcagcttggaaacagacagcagaggttttgtaatcgtttaattcagaaacagcagggagggttcttactctttttgtttgcattaaaagaaaaattacatctgtattaagaaatggattagaaagaaaaacggagaattgggaaatggcagaatatagtgttttaatgtctgtgtatgcaaaagaaaatccggaatacttaagagaaagtattgaaagtatctggagtcagacggttaaaacgaatgatttttgggtggtatgtgatggacctctgacaaaggagctggatgtagtattagaagaaaatcagaaagctcataaagaggtctttcatcttttacgattaaaagaaaatgtgggattgggacgagccttaaatgagggcttaaagtgctgtaaaaatgaagcggttgcaagaatggattctgatgatattgcatgcaaagaccgctgtgaaaaacagcttcgtgtcttagaagaaggaattgacattgtaagtggtaccgtagtagaatttgagaaagacattttgcattgtaaagcaaaaagaacccttcctttatcgaaggaagaaatcttgaaatttgcgggaagaagaaatccgtttaatcatccatgtgtgatgtatcgtaaagaagcagtggaaaaagcaggaggataccagcatttttatctgtttgaggattattatctctgggcgagaatgttgcttttgggagttgaggcgagaaatcttccggatacccttctttacatgcgtgctggaacaggaatgtacaaacgaagaggtggctggaaatatgtaaaatcaatgttacatttccggctttttttatggaaaagcggtctgagcagtttttgggattttgtggtctgtgcaggaggtcagatgatgatttgtctgattccgaaccgcttaagagaactgttttataaaaaatttcttagaaaatagagagtggcttatgagtagatttttagaaaaactggaatttgtcaaaccggcagaccttgtctcaggacttaagatgctggtttcgattccctatgctgcctgtctgaaaaaaaagagaaaacagatgtggctggtttgcgaagaatataatgaggccagagacaatggttattggctttacaaatatatcagaaaagcgcatcccgagcaggatgtggtttatgcgattaacaaagaatccgtagattatgaaaaaattaaaaatttgggagaagtgattcagtatggctcaatcaaacattgggcatattatctggcagcttcgattaatatcagttcccaaaaaggaggaaagccaaatgcggcagtctgctatttattagaggtctatggaattttaaaaaataccagagtgtttttacagcatggtgtcattgaaaatgatctgccgtttttacattatgaaaatacgaagatgcggatgtttatcacaactgcgccaagagagcatcagtttatctgtgaaaaatttggttatccggatggatgggtcaaatgcgtcggaatagcaagactcgatgggctgcatgatgcaaaagtaaagaaaaatcagattctggtcatgccgacctggagaaaatggatttctgttccaagttccgtttcggcaaccttagacgatatgagcagttttgaggcaacggaatactgcaaacgctggatggaagtcttaagaagcagtgaaattgaagaatggcttgcaaacgctggaatggaactggtcttttatccacacagaaatatgcagaaatttatctcgttttttaagacagagagcaagcacgtaaagattgcagactgggaacactacgacgttcagcagttattaaaagaatccgcttttttgattacggattattcaagtatctttaatgactttgcatatatgagaaaaccgatgatttattatcagtttgataatgaaaaattcagaaaagcacagtatgaagaagggtatttttcttttaaggaagatggttttggaccggtatgtgaaacatttgaagagttaaaaacagcattaaaacgtgcgattgatgaaaatttaaaaaatccggaagtttatctaaatcgagagaaagaattttttacgatttgggataccgataactgcaaacgaaattatgaagagattaaaaaattgcaggagagtctttaagtatgaatattttaattgaaggaatgtcaagacagcttggtggaatggaagcttttatcatgtctgtgtaccgtggactcgaccgtgagagctatcgcatggattttatcgcttatgacgatgagattgtgtttgaagacgaattaaaagcaggcggatctaaggtttatcatgtgactccacgttctaaaagtgttcttcagtcaagaaaagagctggataccatttttaaacagacacagtatgatgtattctggaccaacaaaacaacgattagtaatattgaagccttaaaatcggcaaagaaaaatcaggtaccgcttcggatcgtccattctcattcctctgaaaacagaggaacaaaatttacgctgtttatgcataagaaaaacagacgtaaggtggcaaattatgccaatcagctcttagcctgctcgaaagaagcgggtgtctggatgtttggggagaaagcgaaagaagtacaggttattataaacggagtcgatatccgaaaatatacttacacaaaagaacgagaagagaagatgcgcaaagaactgggacttggagacgaaccggttgtaggtcatgtaggacgtctttccaaagagaaaaatcacagctttttatttcgcatttttcgggaaattcagaaaaaagaatcgtctgtcgttctgcttttatgtggaggcggagatgaagctcagaaaaaacagttagaagaagaggcagaagcacttggaatccgtgactctgttcgttttcttggggtcagaagagatgtgcccgatgtacttcaggtgatgaatgtatttgtatttccgtcgctgtttgagggttatccgatttcactgattgaagcacaggcagcaggacttccgacttttggaagcaaagaagccgttccaaaagaaatgggattgacaaaagagatgcattttctttctttagaggaaggagagaaacaatgggcggaggctgtattaaaagaactccattctgaaaaatgttcggaaaccgaagtgttattacaaagtgaagtaagtcttgaaaagatgcttgacacaattcaaaaaatactggaaaagagagggatgaaacatggaaattgatttagtaatcccatgggtcgatggcaacgacccgaagtggcttgccgaaaaaagagcctgcttaaaagaggaagagggagacggacgtgcaaaccgtttccgtgaatgggataatctggaatatctgtttcgtggaattgaaaaaaatcttccatggattcgcaagattcattttattacctggggacatgtaccaaaatggatgaaagtcaatcatccaaaattaaatattgtaaaacataccgattatattccaaaagaatatcttcctacctataattcccatgtgattgaactgaatttacataggattccagatttagcagagcattttatctatgcaaatgatgatactttttttgttgcaccgatgagaccggaacatttctttaaaaacggtctgccatgcgactgtccgcttgagagagtacatgtctttaaaaaaggtggaattgaccacattgttgcaaatgatttggaattattaaacgaccactttctgaaaaaagatactttgaaaaaataccgcaagaaatggttttccttaaattataaacgattattattaaaaaatatctatatgttaggggtcaagcagttcccaggatttgtcaatccacacattccgcttgcatatttaaagagtacgtttgaggaagtctgggagaaagaaccggaagtattagaggaaacctgtaaacataaattgagaaataatatggatgtcaaccagtggctgtgccgttactggcagtttgccaaaggacagttcgagcctggaaatccttatattggaaaattttattcgattggaaaagacgatgaactcattgaacaggcattgaagacaaaacaatataaaatgttatgtttaagtgacgataaaccggaacttgagtttgaaaaagaaaaagaatggctgaaaaaattattacagtcttattttccggaaaaatcttcgtttgaaaaatagggtactctcaaaatctttatgattgagcgtgcataagaaaggacaagttataaatatgaaactcgatgtacgaaagatgataagcgacccgttctggtttgccatgtacatgcttttaatcgcttatcttggagcaccggcgttcttgaagattcatcttggaattttcagaaaagcaggtctggtatggggagcggttttgcttgccatctttttgataaaaaattacagagcttatctggaaaataaatttgcactggtcttgtttttgttctgtgttgcaaatggaatcacgatacttgtaaactggagaaccaaattaagcagcaatatttttacgtttggttatatgaccacttcactgcttttagtttttaatatgtactggcagaaagaggaagaggaagtggaaaagaaaataaaaattttttcctggatgaatgtgattatgccgcttatgtatgcctcaattgcattaattacatttttactttccgttcaagtgtgttatgaacttccgaatggatatcagtatcttggaatgtttgaaaatcgtctatggggcttattcaacccgaacaccggtggaatgatggcggtgatttccatggcattttcgctttatctgataaacaagtcagcacaaaagaaaaaacttctgattgcaaatattgtaattcaatatctgtatctgattttaacacagtcaagaagtgcttatggagcatttgtcttttttattctgattgtaattggatttgtctgggtcaaaagagagaatctattcacaaaggataggaaaacctgcataaagagtcttttaaagtcagttgtcatttttgcctgtgtgttggcactctctccgattgtaaaacatacgattgtattgattccggatgcagtaagttctttgaaaggacaggaagagaaaacagaaatagtaagaaccgaagaattttttgaagaagaagatgcaaacagtgtcagcaacggacgagtggaaatctggaaagccggattaaaagtctggaaaaattctcctgtatttggtgcaggtgcaaattgcatctatgaatacgcaaagagggatttggataaaggaaccgcacaggcgcttcataatggcggacttcacaatgtctatgtgacaacgctggtggcatctggagtggtaggacttggaattttatccgtctttttaattatggtatttattcgctttgtaagagcacttttcacaaaaacagatacatcgacatttattttaatggggctttgcggtggaattttactatcggattttatggaatccagaatcttatatgcaaactcaagtgttcattatattttctggatgacaatggcgtatctgtgctgtaaaataaatgatatcaagaaaaaacaggcatagagaagcgttaggacaaaagctggaataaataagaaaggatatgaccggatggggaaagttagacgatggatgctgatactgtgtgcgatttttatggtgctcggtgcacagtctgtgtatgcggatgatacgcaggattctctcgatggctactggtcaaaagacgaaaatcaggaaatggaagatggggaaaccgtttaccgatattttctatgggatggaacaatgattacggaccagtgggcaaaaatcgaagaggaatggtacttttttgatgccaatggagtcatgcaaagaggctggctttggaaaagtggtggatggtactatctggatgaagaaaccggtgcgatgcagaaaggctggattaaaatcgagaaagatgagtattttttaagtgagtcaagtggaagaatgaaaaccggttggactcattggaaaaagaaatggtactatctggaatcgaatggaaaactggcaaagaatacagaacgttacctgatggggcatacgtttcactttaataaaacaggagaatgggtaaaagattaaatggaagttgtatcaattgtaaaaatgatactgttcacagtggcattttggttgtttttgattgtcataggatttcatacaccggcaaagcggacgaaaaaaattatagaactgcttatgggtggaatgatattatttttctttttatttgaaatattggcattgtgtgcagttttctttcgatggaaatttcatacgctttactggctggtactgggaatctcggtggtgctgtttgtcagttcgattgttcaaaactgggattttattatgagattaatccggtttaagaaacaggaaacgaaaaaacaaaaaggaagcagactctggtatcttccggcggttgtcttaatagtcgttcagatgtatgcagggattttttacacacacattgacgatgatgatgctttttatgtagcgacggcgtcaacaactctcgagacagatacggtgtttcagtacaatgcgtatacaggagatgagtacgagtcccttccaagccgttatgtattatctccatttccaatttttgaagcgggtttaagcaggctttatggagtaccttcaaccgttttgggacatacgggaatgtttttgatttttcttccggttgcttattttgtttatgacctgctgggcagttttttctggaaaaataaaagaaaagagagaggattgttcttacttcttctggcatggatgaatatatttggttattattccgtgtatacgatgtctacttttttactgattcgtatctggcagggaaaagcagtcctggcagcagtgattcttccattgttgttttactatctgctttgtgcttataaaaatgagtatcaaattcaggatattatccagatttttctgacgacaggagcagcagcgctgacctcttccatgggaattttcttagcaccgattatggtggcgcttggggcatttgcgggaattatacagacaagaaaaataggaatagcatggaaattgctggctggatgtattccttgtatcatactgacaggaatttatctgctgttaagagttgagggaatgggatgagtagtgaagtatttgatttgattaaatttttctggaagcattataatggaaagggattttacctgtatctctttttaggcggtatggttctgcttttgtttttaagagagagaaggaaatataaccgttatttgttttggtactgtattggtggactgattttgtactggattccgtatacggcaaaaattattatggactatgcaattggaaagacggtttactggagaatgttctggctgcttccgattacgtttgtgattgcttattttgctgtatcgtgtatctcacagttaaagaacagactttttgcagtggtactggcagtgctgatgctgtccggacttgcctttagtggtcggctggtttacaacaaagatgtatttcataaatcaaccaattattataaactgccacagaccgtgcttggtgtgtgtgatgcaatgaaaaaaaatgccgatggagaggaaattcgggcaattgttccggatgagctgatttcttatgtcagacagtatgacccgtcgattcacctgatttatggacgcgatgcaggcaaggattcaagaaccgataccatggaagctgcgattgtgtatgatgtgattaataatgaagaacaggataaagagacctttcgggaagcgcttgctctttccggctgtaattatcttgtactttcagaagagcataccatggactggtatgcggaagaagaatacgaaaaaatcgcaaaaattgatgagtattgtatttatagaattgacaaatagcaagtaagagatgtctgtatctttttgggtacaggcattttttaatcctttcgattgaaattcataagagaaaatggtatattgtaaaggttaagtatactttaccataagtagaggagattagaatgaacatatttagagaattgtggagaaacaagaccctggtgtggaaactgggtaaaaatgacttcaaaacaaagtatgcaggttcttattttgggattttatgggcctttgtacagcctatggttacaattttgatttacatttttattttccagtttggatttcgcgttatggatacgccaaacggatatccgtatgcgctgtggctgattgcaggtattattccctggtttttcttttcagagggaattatcaatgcaaccaactgtttgatggaatatagttatctggtaaagaaagtcgtatttaaaatcagtgtacttccgcttgtaaaaattttatcggcattgtttgtgcacctgttttttattgcatttgcgatttttatctatattattatgggaaagacaccgattgttcagatggctcagcttggctactatacaatctgcgcaatctgtctgatcactgcgattgcctattttacctgttccatcgtaccgtttttcagagattttggaacgattatcaatatcctgatgcaggttggtatgtgggcatgcccgattatgtgggatatgtcaacgtttaaaatgcctgcaaaagttgaatttcttttaaaattaaatccgctgtattatgttgtacagggatatcgtgacagtttcatggatggaatctggttctttgagagaccaaagatgacgatttacttctgggttgtaactttaattatcggagtgattggatttactgtattccgtagattaagagtacatttctcagatgtattgtaggagggacacatggacgatattgtagtatcaattaaagatgtcagtaaagtatacaaattatatgataaaccgatagacaggctgaaagaatccctgtctattacgcataagagctatcatcaggaccattttgccttagagggaatttcacttgatgtgcataagggagaatgtgttggaattatcggaacaaacggttccggaaaatctacgctgttaaagattattaccggtgtattaagtccgacaaccggaagtgttaccgtcaatgggaaaatcagtgcgcttcttgaattgggtgccggctttaatatggaatatacgggaattgaaaatatttatctgaatggtaccatgcttgggttttcaagagaagagatgacagcaaaacttgatgatattattaattttgcagagattggcgattttatcaatcagccatgtaagacttattcgagtggtatgtttgcccgccttgcatttgcggttgctatcaatgtagagccggatattttgattgtcgatgaagcattgagcgttggagatattttcttccagtcgaaatgttaccgtaaattcaatgaatttaaagaagcaggaaaaacaattatttttgttacgcatgatatgggaagtgttatcaaatactgtgaaagaagtatgctgattcatcacggacatcatgtactgaccggaacgtccgcagaagcagtggatgtatataagaaaatccttgcaaatcaatatgatgacagtgcaaaggacgaagaacaggaagaaactacagaggtagaaactcaggaaacagaaacgaaagaaaaacaggaagcaaaaggctggaagagtaaattaactttaaacagcaatctggattcttatggaagtctggatgcagagattgtggattttgcaattgtgaatgataagggagaaatcagttcttccgtagataaaaataaacagttccgtattaagatgaagattcagtttaaaaaagatgtggaccatccaatttttgcttatacgattaaagacagaaaaggtacggaaattacaggtaccaataccatgttggaaaattatacaccggcacactgtaaggcaggggagatcgttaccgttaattttgaccagattatgacgcttcagccagggcagtattttctttcttttggttgtaccggttataatggggatgatttggagatttatcacagactttataatgcctgtcaccttgaagtcttttcaaagaaagagggaacgcttggtttctttgatttgaattcaacggtttcttatgacggggcaatacaaacgaaataataaataatagaaggattatatgggatgaacgaaaagattgggaaagttacattaaatctggactattatgaaggtcaggatttttacagtgacggtgtgattgaagagcatctgttagagctggtgaaacatcacgaacctgaagagtatcaggatattatcttaaaagaaaaaaactgggctgtgatgtatcatctttcacagcaaagagagaatattttagagtggtatccgataacaaaggaagattccgtgcttgaaatcggagccggatgtggtgcaatctctggtgtgcttgcaaaaaaagccggacgggttgtggcaaatgacctgtctaagatgagaagttcaattaatgcatggaagaataaagaggcagaaaatctggagattgtagtcggaaactttaatacggtatctgataatctgacagaaacctttgattatgttaccttgattggcgtgtttgagtatgcaaagacttatattcaggaagaagagccatatcgggtatttttagataaaatcaaccgtcatttaaaaccgaatggaaagattttgatggcaattgaaaataagctgggactaaaatactttgcaggctgtaaagaagaccatgtcggtcggatgtttgaaggaattgaaggctataaaaatacatccggagtagagacattcagcaaaagagaattagagaaactgctcgatgcaaatggctatcacaattatcggttctattatccttatccggattataaatttgcaacaaccatttattcagattcttatcttccaaaaaaaggagaactgcggaataaccgccgaaattttgatgcagagcgtctgttactttttgatgagggacttgcctttgataccatgattcgtgctgaattattcccgcatttttccaattccttttttgtagaaattcagaaaaaggaggaaaacaatgcctgagatattatattcaaaattttcaaaagaccgtcagaaaaaatttcagattgcaacgatgattgtagaagaaaatggagaaaaatcggtcataaaaaaagcgatgcataaagagggagaagcccatgtaagaaagatggtcgaatcccgagaactgctttcggaattatttgtaaattcaggtgtggaaatgtgtccatgcaaagaggaaaatggtcaggtccgttttttatttgtggagggggaaagcttagaagaaagaatccaccgccattcagaagcaaatgactatgaagccttgaaagaggattatcgttttcttgcaaagattattttttccgtaaaaggaatgcatacattcgagagcagtccggcatttgaagaaatttttggctttccaaagtttaaagaagcgcaacattcggcagatatttccaatgttgatatgattccggcaaatcttctgtttggtaaaaaatgtgtgctggcagattatgaatgggtctttttctttgagatcccattagaatttatctatgcaagaagcattttcttgcaggaagcagtctgcggtttagataagagtcagttagaagaactctatgcaattggtcgtgtagatatggaagaagtgccggtttattatcaaatggaagtgaacttccaggaatatgtggctggaaaaggcgaaaaatatgccctgtcccatctgtaccagaaaatgcactgtaaatcttatcctgtcagtgaatgggattataagaaacagttcttttctatcggtatcgagggagataccggtgaagaatgggaagaaatcagctacgagcagaccattcattctgagattaagagaacgattcaattaaaagcaaaccaatataccagacttcggttcaaaccggtggattctaaaagtattataaaaatcaggaaactggtcggaaagaaagaaaaacaggaagttagtttgaattttactcataatgcaaaactggtgattattgatgattattatttcatagaaccaccggtacttgaaatcgcacttgatggatgtgaagaaatcgaatttgattatttggtttatcgcagaaatgatggtgtcattgatcagatggtgacatttattcagaatgagaaagcgttaaaagatgagagacagatgctgactgaaaaaaatgcagcacacgaagccaggatagccaaacttggaaaagagttaaatgacttacaggcgaccgtagaatatcaggcagaaaaaatccgacagcttgaaaatttaaaagtctataagatgtatcaaaaagtacgtaaaatagtgaaaaggggtaattgatgtatggacgtatccattgtaattcctactaagaatgcaggtcctttatttgaaaaagtgctggatatgatattttcccagaaaaccatttatgaatatgaggttatctgtgtggattccggttcaaaagatcagacacttgaggtaattaaaaaatatccgtgcaaattatatcagattccggcatcagaatttggacatggaaaaaccagaaattacggggcttctaagggaacaggaacttatattgtatttattacacaggatgcacttcctgcaacggacacctggcttcagaattttattgatgccatgaaaaaagacccggaagtggtgggtggatttggaatccattatccttatccaggctgtaattttatagataagagagatattgaaggattatttcagggatttggttctgataatacgattttttatatggaagataaggaacgctatgaaagagaagaaggatatcgacatgtacttgctttcttctcagataataattcctgtgtcagaagagatgtatttgaacagcatccttatgatgatgttaattttgcagaggatcagatttgggcgagaaagatgatcgagttgggttataaaaaagtatactgcccgtttgcaccggtttatcattctcacaactttaaattaagtacttactttgcaagatattatgatgaatataaaggtctctatgaaattcatcagtatatgatggcacagcattttcgccagctcccacgtctttgggtgcgtcaggtcagaggagactgtgcttacatccgtcaacagccgatcggaaagaaaacaaaaatcaaatgggctatttactccgcatttcgtaatttcgaccgttttgtcggggggacacttggcggaaagtaccatacttattcggaagcaaaacagaaatttctggacaaacatatttcacagcagtacagacaaagaaaggcttaactggtcttaggtgagaaaggaaaaaagaatgagcgataatgtagtagaaagaggaatgagatatttaaagaataatggcgtgaaagcaacattaaaacgtatgaaaaacggacctgcaccgattccgccaaagaacaatctgcttggattttataattttgtagtcaatacagaagaaattccatttgataaaaaggcgtatgaagaggcaaagaaatctggaaaaatcacattaaactgggtcattccggaaatgagtccgggttcaggcggacataccacaatttttcgttttgtatcaaatttggaaaaattaggttttcacagcaaaatttatctgtatatgtctccgacatttaaagataatgagtccatccgcagtttcttaaaacagcacttcccactgttagatgagagagtagaagtttactgtgatgtgtcacagatgggatttgcacacggcacagttgcaacagcatggaccactgcttactatgtcagaagatttaataataccatttctaaattttattttgtacaggactttgaaccatatttttatgcacatggttcagaatatgagtttgcagaaaatacttataaaatgggatttcgtggaattactgccggtgactggttaaaagatgtaatgagaaacgattatggcatgacagcagatagtttcttattctcttacgatgacaagatttacaaaccaaaagaaaaaacagatgacaaaccgagagtattcttctatgcaagaccggttactccaagacgtgactttgagcttggtatgctggcaatcaatgaattatggaagaaaatgccggacttagaggttatttttgcaggatgggatgtcagcaactatgaaattccattcccacatcagaatcttggaactgtaacaccacaggtacttgcagattcttatgtaaaatgtgatatgtgtctgattatttcaaacacaaacctgtccctgctgccacttgaagttatggcttgtaactctgttgcagtctgctcgaaaggagaaaacagcacctggcttgtcaatgaagaaaattctatcttagtagattatgacccgaatcagattgcagatacaatggaagattacttcaaacacccggaaaaattagcttcaatccgtaaaaaaggtctggaatttgcaaaaaatacttcatgggaaagagaagcagaaaaagtaaaagaggcaattcttagaggaattcatgaagatgagcagaaaattcaaaaataaacagaaacttggacggacagtctgcatgatttttgccctgcttctggtatttggaatttatctggcatgggcctgcagtcagaggcataatttttcacccgatgaagggatgcgttcccgaatcgtgcagtatatctatgagcatggaaaactgccgcacggtggagaccccgagataagagatgaagattggggaatttcgtatgcgtttaatccgattttaagttacatgatttctgcgttgtttatgaagattacttcatttttcacgacagatgagtgggcactgttgatttctgcaagaatggttaatgttctattcggaacagcgtcagcgtattgtatttttaaaatcggagaagcattattcaaaaaaggagaaagggtgatgttctttttcctttgtaccctgcttcccggtgctgcaattttatatacttatatcaattgtgacggacttgccttattttcctcatcgtttattatttatatgtgggtgagggcaatgaatgagggctggacaaagaagaacagtattctgcttggaattgcattatcactttgtgcgctttcctattatgatgcttatggttatgcactgtgcagtattttattctttgtcgtttcctcccttggttatggcaaaaagaaaccggattttaaattaatgttcaaaagaggtctgttaatcacggcagttgtggcagtgcttgccggatggtggtttgtaagaaactatatcatctatgatggagattttcttgcaagaaaaaccatgcatgagtatgcaatcaaatatgcaaagccacagtttaatccccaaaatgtaacgacatttaaggattatccggaggcaaacattatctcgatgttaaaatatcatgctcccggttttaagtaccgctggattggaatggtagtctatggggtagttggaatctttggatacaatcagatctttcttggaaaaaaagtgtattatccatattttgcattgattcttgtcgggctggtatttgtaatctggaaagcaagagatattttctatttaaaacgagagcaggttatgcttgagaagaaaatcaatgaagaagaaaccgtagaacaggtattaatccgtcagaaaggaatccgtccgcagggattattccatctgtgtcttttacttggaatgataattccgaatgttttgaacttatattattcttatacttcagattatcagccacagggacgctacagcatgccgatgttagttccgatgatgtattttgtaacgatgggatattcgagagtcgcagaccattttattaaaaatcagaaattaaaacagctttgttattatctggtttcagcaggaacaattgtagttgcactgtttttatgggcaagactgttgtacccattatatcttcagaactataatggtctgcattaatggatttccggaatttttcaacagacagattctgggagtgcatgattagtcataaggaggaataagatgccaaattggaacaatctcacgtcaaaggtaattcagacggtagaagcagacggaattttgggacttggaaaacgcggtggcagatatttaaaaaaaaggttcggagctttagcaaaaaaagagtccgaaccggtttttaaagatgtgctgtttattgatggatgtggaacagtactgccacatccgtcaagatatcgtgtcagccatcaaagagaacagcttttatcttatggaattacatcagaccaggtgtactttgcagatttggatttaaaacagattggctggtataatgtgtttgtattttttcgctgtccactcaatgagacaacggaaaaatttgtaaaattagcaaaaaagtatcaaaaaacagttttatatgatattgatgaccttgtatttgatataaaatacacagatacgattccttatgtaactgcgcttgaaaaaaaagaaagagaagcctatgatgagaatgttcgggcgtatggacagctccttgacttatgtcagggggctgttaccactacaggggaattatcagaagcattgaagctgcatgtaaaagaggtctgcatcaatcgaaacagggcttctgaggaaatgatgcagatttccgaaacagcattaaatcaaaaaacagaacataaagaagttgtacgtttaggttattttagtggaagcattacgcataatccagacattgaaatgctgctgccggtgctcttaaagttaatgagacaatataagaatctggaatttgtcagtgtgggagagctggaaattccggaagaattaaaagaatttgcagaccgaatcaagattcttccgtttgtggactggaaaaatcttccgaaattgatttcagatgtagatattaatttagctccactcgaagatacgatttttaaccgcgcaaaatcagaaaataaatgggtggaagcttcccttgttcaggtggtaacggtggcgtcgaatctgggtgcatttgccgatacgattgaaaatcaaaaaaccggatttttatgcaaggatttaaaagaatgggaagaaacgctgtgcgctttgattgaacagccaaaacttcgcagaaaaactgcgatgcaggcatatcagttttgtaaagaagcctatcttacaacctatacaggaaagacactggtggattttatcaaagccaaacggaccaaaaatgttggaatcctgcttccggcacttaatatcagcggtggaatcatggtggcaatgtggcatgccgttttcttaagggaggctggatttgatgtcacgattctttcagaaaatacaacggaaacttcatgtgtctttgaaaatcagaattttccggtgatcccattaagagaggatgcagtcagcggtcactttgataagatgattgcaacgatgtgggtcacagtaaaatggctggaattattttcgaatattgataaaaaatattatctggtgcagaattatgagacggatttttatgaaaaaggcagtccatatcgtgcaatggcaaacgccacctattgcaaaaaccagattcagtatgttacgatatcaaagtggtgtaaggaatggttaaaagaacggtttgaaaaggaatgtgcttatgcaccaaatgggttggacactcgggtttttactccatgtgctcgtgattttagcggaaaaatccgaattttaatcgagggagactgcggtgcatggcataaaaatgtagatgaaagttttcagattgtagagaaactcgatagagagaaatttgaaatctggtatctttcctacaattcagagccaaaagaatggtacaagccggaccgttttcttcataaagttccatttcaaaaagtgtcagaagtatacaaacagtgccatattctggtaaaatcaagcatactggagagcttttcctatcctccgcttgagatgatggcaaccggaggtcttgtagttgtccgtccaaatagtggaaacaaagaatatttaagagatggggaaaactgtctgttatatgagcctgaaaatatttctgaggcagtggaaaagattatggaattggcagaaaatgagacacttcggaaacatctgacagagggcggacttaagactgcaaggcaaagagaatgggaaactgtaaaacagcagattttaaatctgtatctggaagcaggagaataaaatgatgaaagcaaaaaacttaataaaacgagtaacgattggcattttggcagttgtgcttagcacttctgttgtgtgggcggacgataatccagggctgattcaaagggcaaaagatgcctgtaaaaatgcaacctatgatatcccgacagtgacaaatgacattgacggctggccacaaggactggcaattatgtgtgattcagctgttgtgatggaagctgaaagtggagaagtgctttataataaagcaatggatgaacgccgttatccggcaagtacgacaaagattatgacggcactggtcgcactggaacattctaatctgactgatacggtcacctttacagcagaaggtttaaaagaagctgttcctggaaacagttatgtgactccggtcattcaggaaggtgagacactcaccatggaacaatgtctgtatgcgattatgcttgtctcaggaaatgaagtttcgacacaggtggcaatgcaggttggcggaagcgtagaaggctttgtggaaatgatgaatgagaaagcccaggaaatcggatgtaaagatacacattttgtcaatgcgaacggacttcatgatgaaaaccattatacaaccgcgcacgatttggcgatgattgcacaggaagcttacaaaaacgaagaatttcgcaaaattgtaggaagtcgttattatacgattccggcaacgaataagactgccgaggagcgtgtacttgcaaaccatcatgcgttgcttggagagggtgactggcattatgacggctgtcttggaggaaagaccggttataccgacaccgctttaaatacgttagtcacttattttgaaaaagacggaaccgtttatatttgtgtggttttacattacaaaggcacagaagtttttaccgatacagttatgcttgcagaatataccaaagaattcgaaaaactgcaggtatcaccaaaaaaatatacactctcaggcggaaccgcagttgtgccaaaaggaacaacaacggatgcgcttgagatacagagtacacaaaacgaagatggaaacgaacaggaaacctttttatttaatggatatgaagtcggtcaggcagttgtagatacgaaagcttatgaggcagataaaaaagctgaagaagcacagaaggaagaagagtcaaaagaagagcagagccagaataacgaggcacaaagcggttcttttagtacatttgaaattgcagtggttgtgcttgtaggtttgattggacttggactgattttaatcgtgatttctgtgataaaaaagaaaaaaaagaaatgataagcaggtgagaagatggcaaaaggaaaaattgaatggggcagaatgttagggaaactttctccttataccattctaaaagggcttcgctatatgaagcattatggtccgaaagaattctggattcggcttcatgaaagatttgaacccgaagaagtcccttatggtccatggtatgaggaatataaggtgaaaccggaagaactggaaaaacagaaaaagaaaaaatggaactacgaaccgaaaatcagtgtagttgttcctgcttataagacaccggagaaatttttaagagagatgatagattctctgcttgcgcaaagctatgcgaactgggagctttgtattgcaaatgcaagtccagatgaagcagggatgagccagattttggaagaatactgcaaaaaagatgccagaatctgtgtcaaaccgcttcttaacaatgcaggaattgcagaaaacaccaatgaagcattgaagatggcaacaggagattttatcggtttgttagatcatgatgacctgcttgcaccaaatgcactgtatgaagttgcaaaagcattagagagtcatccgaagactgatgtgatttatacggatgaggataaggtaagagcagatttatcggaacatttccagccgaatttaaaaccagattttaaccttgatttgcttcgttctaataattatatttgccatttctttgtggtgcgccggacaattgtggaaacaattggtggattcaggaaagaatatgacggagcacaggattatgattttattttccgctgttgtgaaagtgcgaaagagatttatcatgtgccggaaatcttatatcactggagaacgcatcaggcatcgacagcagacaatccggcaagtaagatgtatgcgtttgaagccggaaaacgtgcaattgaaggtaatttagaaagatgtcatttaaaagcagaagtcagtcataccaaagaccttggtttttaccgtgttaaatacgaggtggaaggtacaccgcttatctcgattattattccaaataaggatgaaagagagtccttaaaaaaatgcattgattcgatagagaaaaaatcgacttatgaaaattatgaaattttaattgtagaaaacaacagtacttcaaaagaaatctttgagtactataaagaattaagtgataatcctaaaattcgcctgttaaaatggaaagagggatttaactattctgcaattaataactttgcggcaaagaaggcaaaaggtgagtatcttttgttcttaaataacgatatggaagtgattgcatcggactggatggaagaactgcttggacactgtcagagagagggaacaggggcagttggggcaagactctattatccaaatgagacgattcagcatgccggcacgattatcggaattggcggaattgccggtcatatgtttgttgatatgccgggagaacgtaccggatatatgcataaggcagcgattcagcaggatttaagtgcagtgacagcagcctgtatgatggtaaagagaagcgtatttgaagcagtaaacggatttgaagagaaactttcagttgcctttaatgatgtggatttgtgtctcagaattcgtgcacagggcgaattaatcgtatatgacccttacgtggaactgtatcattatgaatcaaagagcaggggaacagaggacagtaaagaaaaagtcagaagatttcaggaagaaattgagtttatgcgctgtcgctgggagaaactgttaaaagccggagacccgtattacaataagcatttttcactgacaaagtggaattattctttaaagccatttgagtaaggggaacaggtatgcaggatgtatcagtgattattccgaattttaacggaaaaaagtatttaaaagagtgcctggactcgttaagaaaacaggattatttgtattttgaagtgattttggtcgataatggctcagaagatggaagtgtggaatggacaaaggaaaattatccggaggtacgtgtgattgcgctcaaagaaaataccggtttttgtggcggagtcaatgcaggaatccgtgagtcaaaatcagaatatgtattgttattaaataacgatacgattgtatttccggaatttattacagaactggttcatgcaatcgaacgggcaccggatatcttttcatgtcaggcgaaaatgcttcagattcaggatgaaaacaagatggatgacgcaggaaatttttactgcgcacttggatgggcatttgccgatggaaagggaaaaccggagtcagagtacaataagaccagagaaatttttgcttcctgtgcgggagctgcgatttatcgtaaagaaattttagatgaaattggctattttgatgaggaacattttgcctatcttgaggatgttgatatcggatatcgtgctaaactgcatggatatcgaaatctgttttgtccgactgcgagagtactgcatgttggaagcggaacaagtggatcgagatataatttatttaaaattcgatattcttcaagaaacaatctgtatttgatttataaaaatatgcctctttggcagattattttaaatttcccgcttttgtttgtgggatttacaataaaaacagtcttttttgcaagcaaaggttttggaaaagattacatcaaaggaatgtggaatggaattgtaatctcgaaagagaacaaggaaaagaaagtaagaaatgtagcacatcagagggaacggtgttggaagatacagctggaattatataaaaacataggaaaacgctttcgttctgaaaagagaaagtaagatactttcgaaattttacagaaagatttcgaaagtacataatagacatagaaagaagtatagagaggaaacaatgaagatacaggtaggaaaaaaagagctttccgagaagcagaaaaaaattttaagaaaagtaaaagtgattttgcaatatgtttttatcttcctgtcgctgttaattgcaacaacggttgcctgggtatttcgcacctggaagggccttacaatggaagaggtggtattccacattcaggcaccgacaacaggaacagattcgggaattatttcgagttttattctaacgtgccctttgatttcgattgtgttaacgttagtaattttattgctacataaaagactgggaaaaataaaagatattgcggttttgggtttaatggtggcatttcttgcagtagcagcattttctgttggttatatgtggaatcggcttgacattaccgcttatgcaaaaaatcagacaacagaatctacgtttatcgaggataattatgcagacccaaaagaagtagagctgacttttccggagaaaaaacgaaatttgatttatatttatctggaatcgatggaagatacttatgcagataaaaaaagcggaggtgcatttgaaaagagccggattccggaactggcaaaattatcacttgaaaatgaaaatttttccggaaatagcacagccttaaatggtggaatcccaatgtacggggcaacctggactatgggggcattattcgcacaaacttctggtctgccgttaaatcttccgatccgaggagatttgatgagtacgcagtctgaatttcttccgggtgtaatcaatcttggagatatcttagaagagaacggatacaaacagtactttctgatggggtcagaggcagaatttgccggacgcgatttgtattataaacagcatggcaattatacgatttatgattataattacagtctcgaaaatggagaaattccagaagattatcacgtgttctggggctatgaagatgcgaaactgtttgaatttgcaaaacagcatttgacccaaatcagtaaaaataacgaaccatttaacttttcaatgttgacggtcgatacgcattttgaagatggatatcgttgtaaggactgtccgaatactttcggagatgaccagtatgcaaatgtaatggcatgctcaagtaaaaaagtaacggaatttgtaaaatggattcaagaacaggatttctatgaaaatactacgattgtcatttcgggagaccatctgacaatggacagcaatttctgtgatgatgtgccgtcctcttatgaacgaaaagtctatactacttatatcaattccgcagtacaaccggagacagaagactatagagaatattccacaatggataactttccgacaacccttgcaagccttggcgtagagatttcgggaaatcgtttagggcttggtacaaatttattttcaagcgaagagacattaattgaaacatatggaaaagagcaagttaataccggattgaaaatgaaatccaaatttatggatgagctaacaaaagatattgtagtggaaaacgccaaaaaagtgcaggaagaagaaaaggcagaagcagaggagaaaaaaattactgcagatatcacggtttcagattatgatgcactgagtgattcgtttaaagtaagcttaagtaaggtaaaatgccagctcccggtggaatccatccaatgtacagtatggaaatccgatggcatgaaagcccttgtatggtatgaagccgaaaaacaagaagatggtacttacagtatcgaagtaaagggcagtgaccttgcgcacgaagaaggcagttatgatgtcattgtctatggacaggcagaaggctatgatccatctgttattaaaactgttaccggcgaaatcaaagagccggagtctaagataacggcagatgtgacagtaacaaactatgatttcagaaaaggttactttgatgtcattttaagtaatgtagaaagtacagagccggttactgcaattgaatgtacggtttgggaaaaggatggtactgtggcattaaaaacctatcaggcgaaacgtcagggtgatggaacctatctgcttcgaatcaaggcgatggacttctattataagacaggaacctatcgaattttgatttacggtcagactgaaaattcaccgatgatgcagatggatgaagtgtttggagagattacaggataaaaacaagagaataaataaaaaaaggcgaatgaccgaaacgtcattcgcctttaaaattttcaagattagaaattagaatttaaaagtatccttaagtccgagccatttctggtctttgtcgcttaagtttaacgcagtgccatcttctaagacatagccttcagaagatgcagtgccattataagtaccgattaattttggccatttgataccgattttcgggtcgttccatgcaagaccgccttcatctcccggatgatagaaatcagtacatttgtagcagaattctgcaatgtcacttaatacaagaaatccgtgtgcaaagccttccggaatataaaactgttttttgttctcttcggtcagttccacaccaaaccattttccataagtcttgctgtcacttcttaaatcaacggcaacatcaaagacagagccttttaccacacgcaccagtttgccctgtggaaattctttctggaaatgaagtccacgtaagactcccttggtagaactggactgattgtcctgtacaaaattcatggtaagtccggcttctatcatatctttctgattgtaggtttccatgaaatatcctctggcatctccatgtacagtcggttcgattacacagagtccttcgataccacctgcatttttttcaactttaatctgtcccattttatttactcctgtgtttttaaatccttaagataacggtttaatgcatcctgccaggttggtaagagtgcaaaaccatttgcggttaatttgctcttgtcaagacggctgttaaacggtcttgctgccttggaaataccatattcggcagttgtgacaggagctacggttaaatgttctttggaatactcctcctcgcccatgatttcataagcctgacggaagatttctgtggcaaaatcataccagctgatgtaaccgccctcattggttgcatgatagtaaccgtatttttctgtttcaatcatatcaactaagagtctggcaaggtcaaaggtataagtcggtgtaccaatctggtcatttactacggttaatttatcatgattttttccaactttgagcatggttttaataaagttatttccgtttaaaccaaatacccatgcaattcttacgatgaagtatttggaaagcgtttccgatactgcaagttctccggcaagtttactctttccatagacatttaacggtttgtagtctttgcagtccggtttccatggagtttctccctgaccgtcaaagacatagtctgttgaaatatacatcattttgataccaagttctttgcagacattggcaatattttgtgtgccagtgccatttacaagcatgactttttcctgatttgcttcatcttcagcggcgtcaaccgcagtccatgcggcacagtgaatcactgcatccggagctgcttctttgataacctggttgacagaagcagagtctgtgatatccatttcttcgatatcaacaccgattggagtatgacctctttttttgagttcatttacggtatcgtatccaagctggccttttacacctgttactaaaactttcatggaaggtttcctcctttaataattagcggtttccgtacattttttcatagtagttctgatattcaccggaaatgatattttcccaccattctttgttatctaaataccactggattgttttcttgattccatctgcaaacttggtttccggaagccatcccagttcattgtgaatcttggtcgggtcgattgcgtagcgcatgtcatgtccttttctgtctgtgacataagtaatcaggctttctggttttccaagttctttacagataatttttacaatatcaatgtttttcatttcattgtgaccgccgatgttgtaaacttcaccgacacgtccattgtgaatgattaaatcgattgctttacagtggtcttccacgtaaagccagtctcttacgttttcaccttttccgtaaacaggaagcggtttgtcatttaatgcatttgcaatcataagcggaatcagtttttcaggaaaatgatatggtccgtagttgttagaacaacggctgatggtaacaggaagtccgtaagttctgtggtatgcaagaaccaataagtctgcgcccgctttggaagaactgtaaggactgctggtgtgaatcggagtttcttctgtaaagaataagtctgggcggtcaagtggcaggtctccgtaaacttcatcggtagatacctgatggtaacgtttgattccatatttacggcaggcatccattaagacagcagtacctttgatgtttgtatcaaggaaaacttccggattttcgatagaacggtcaacatggctttcagcggcaaagtttacaaccatatccgggtgctcttcttcaaacagtttataaacggcttcacggtctgtgatgctttcttttacaaaacggaaatttgggttttccataacggattccagtgttgaaagatttccggcataagttaagcagtctaagcagacaatacgataatccgggtatttgtctaacatatgaaaaataaagttacttccaataaatccggcaccgccggttacaataattgtcataatttaaaattctccttttcgtgatgcgaataatggttagtgtaaaacgtctaaatattttccatcgagtacgtcttttaagtattgtccgtactggtttttctttaagacttcatacactttaagaacctcttctttggtaatccagccatttaagtaagcgatttcttcaaggcaggcaatctttctgtgctggtgggattccatggtttttacaaagttggttgcctcaaccagactttcgtgtgtaccggtgtcaagccaggtaaatccctgtcctaataattcaacatttaagttgccgttttccagataaatacggtttaagtcagtgatttcaagctcaccacgtgcacttggttttaagttctttgcatattcgactactttgttgtcatagaaataaagtcctgtgacacagtaattgctctttggatgttccggtttttcttcgatagaaacagctttgccttcgtgattaaattcaacaataccgaaacgttccgggtcatcaacatagtatccaaataccgttgcaccctttccggattctgcattttcaacggcggcttttaagcgttttttcagaccgtgacctgcaaaaatgttgtctccaagcaccattgcgacagtgtcatctttgataaagtcctcaccgataataaaagcctgtgccagtccatccgggcttggctgtacggcataagacagatgcactccaaattgatgtccgtcgcctaagagttccttaaaacgaggagtatcctgcggagtagaaataattaagatatcacggatgccggcattcatcagtacggacatcggatagtaaatcatcggtttgtcataaattggcaacagctgtttggaagttaccatagttaaaggatagaggcgggttccggaaccaccggctaaaataattcccttcatgtgaaaatctcctttcttaaaagaggtagtgtaatgttacttttttgtctcgtagtttctgataatactattataaaagatgacgtaaggtcaccttcaagcgtttttttaaaaagtacataaaaaaattccggcgtcttttgtaatgtgaaatccatgggcggtttttttctcgacaaagctgcgaaactcatggtaacgttccaataacatctggttttgatttccatgacaggaaagaatgtactcaattaaaggttcggcacggtcaagctcaatcgaatcttcatatcggatacactgaacgtcagaaaagtaaggctttaaaagtgcttctccattttcaagcccgaactgttcatataatttttccgcagataagacaatccggctgtcaaattcctgaacaagttcactgatttcaatcatgtggcgctttccataggtactgcagagaaaatggccgcctttttttaatgatctttgaatctgcttaaaaacttttggtaaatcattgcagtaaaacaggacatggtttgcgataattaaatcaaaggcagaaagcgaagacggaaaagaatgacagtcaaaacaggcaaaggaaaaccgcttatcaccggacggcaggtttcttctggcatctcgtaacattccgtccgaaacatccgataataaaatagagaggttcgatgggatatgattcagattttccgtccataatgctccatttccacagccaatttcaagtacccgctcattgggctttaaattgcaatgttcaaaaatccacggaaaccagccttttgaattggtagaatattccttgtgcagacgaattcggctggaaatattggaagcattctgatattgagatttgagacttttttccatatttgttaaatgaatcaggtcaagcatctggctccagtcaatttggtgttcctgttcaatcactcggacggtatcttcgattgcactttctacaagctgcatctgttcaatctggtcctggattaatttcttttgaagattaagggagtttaacagaaagagataatcagaatcgtcgatggtcatttcacgaatatcgtcgagggaaaatccaagatattttaacagtagaatctgctggagacgggcaaaatcagagtccgtatagaaacgtgcaccggctggtgtcacataagaaggttttaaaatgttttgtttatcatagaatcgaatcgtgcgtacagagacatttgccatgcgggcaaactgccctgaagaataataacctggcagtttcataagaaaagtcctccataaaaaatataagaaatccaagataatggaacgataatcctgcaattccaaaaaatcctaaaaaagaataaaaaaaggatgcaggagatgggacttgaacccacacgatattgctaccacaggcacctgaagcctgcgcgtctgccaattccgccactcctgcatctgttattaagttatgttctcgcgaacacaagcaatactatacaatagtatgttgaaaatgtcaatacttttttggaaaattcctgcaattcataaaaataaattcctgcaatccgtaagtaaaaataaaaaagaataaaaaaaggatgcaggagatgggacttgaacccacacgatattgctaccacaggcacctgaagcctgcgcgtctgccaattccgccactcctgcatctgttattaagtttgcgcttttgtaagcacaaggaatactatacaataatatgtaaaaaaagtcaagactattttgaaaaaaataatcgaaaaagataaaaagagatgtggtataatataaagtaatctcagaatatttacggagcttatctttgtggctgattgtctgagggaacaggaaaaagtgagcagaagataaaaaattttaaaactgtaaaaaatatagaaaaaaaggttgaaaaatgaaatatcttgtgatacactttttacaatttggggaaaaataggaaacccgtaaactaacagcaagaaataggaaagggagacaggtgaaaaaatgaaagcatttttgatactggaagacggcaccgtctttaccggcaccagcattgggtcgaaaaaagaaattattagtgagatagtctttaatacatctatgacaggttatcttgaagtccttacggacccttcttatgccggacaggctgtctgcatgacatatccgttaattggtaactatggcatctgccacgaagaccaggagtctttgagaccgtggccagatggttacatcgtcagagaattatcacgaattccaagtaatttccgctgtgaagatacagttcaaaactttcttaagaagtatgatattccgggaattgccggaatcgacacaagagcactgacaaaaatcttaagagaaaaaggtaccatgaatggtatgattacaacgaatgaaaactacaatctggatgagattattccgaaattaaaagaatatacaacaggaaaagtagttgagcgggttacctgcgaagaaaaacatgttttaaaaggaaatggtccaaaagttgcattgcttgactttggtgcaaaagaaaacattgcaaaatccttaaatgagagaggatgcgaagtgacaatttatcctgcagcaacaccggcggaagaaatcttaaagagcaatccggacggaattatgctctcaaacggacctggagacccgaaagaatgtgtttccattataaaagaagtaaagaaactttatgattcagaagttccgatttttgcaatctgccttggacatcagttaatggcattagcaacaggtgcagataccaagaagatgaaatacggacacagaggaggaaatcatccggtaaaagatttggaaaccggaagagtttatatttcttctcagaaccatggttatatggtagatacagataccttagaccaaaatgtggcagtgccggcatttgaaaatgtaaatgataagacaaacgaaggattgaaatatatcggaaagaatatttttaccgtacagttccatccggaagcatgcccgggaccacaggattcaggatacttatttgacagatttatgaagatgatggaggaaagcaaataatgccgaagattcaggatattaaaaaagtacttgtaatcggctccggtccgattgtaatcggacaggcagcagagtttgactatgcgggaacacaggcttgccgttccttgaaagaagaaggaattgaagttgtactcttaaactccaatccggcaaccatcatgacagataaagatattgcagaccgcgtttatattgaaccgcttaccgttgaagtggtagagcagttaattatgaaagaaaaaccggacagtgtgcttccgactcttggtggacaggcaggattaaaccttgcaatggaacttgaagaaagaggattcttaaaagaacatcatgtacgtctgatcggtactacttcccagactataaaaaaagcagaagaccgtcaggaatttaaagataccatggaaaaaatcggagagccggttgcagcatctttagttgtacgtagtgtagaagcaggtattgagtttacgaataagatcggttatccggttgtacttcgtccggcttacacccttggtggaagcggtggtggtatcgcttataatgaagaacagttagtagaaattctggaaaatggtctgcgtctttctcgtgttggagaagttttagtagaacgttgtatcgcaggatggaaagaaattgaatacgaagtaatgcgtgacggtgcaggaaactgtattaccgtttgtaacatggaaaacattgatccggttggtgtccataccggagacagtatcgtagttgcaccatctcagactcttggtgacaaagagtatcagatgcttcgtacttctgcactcaatatcattacagaacttggaattacaggtggatgtaacgtacagtatgcattaaatccagacagctttgaatactgtgttatcgaagtaaacccgcgagtttcccgttcttctgcactggcttctaaagcaaccggttacccgattgcaaaagttgcagcaaagattgcacttggttatacacttgatgaaattccaaatgcaattacaggaaaaacttatgcaagtttcgagccaatgctggactactgtgttgtaaagattccgcgtctgccgttcgataaattcatcagtgcaaagagaactttaactacacagatgaaagcaaccggagaagttatgagcatctgcaataactttgaaggtgcattaatgaaagctatccgttctctggaacagcatgtagacagtcttatgtcttatgactttgcaagcttgacaaaagaagaattaatcgaagaattaaaaattgtcgatgatatgagaatctggagaattgcagaagcaatcagaaaaggcatttcttatgaagaaattcatgcaattacaaagattgacatctggttcatcgataaacttgcaattcttgtagaaatggaacaggcgttaagagaacaggaattaacagaagacttactgcgtgaggcaaagagaatcgaattcccggacaatgtcattgcacgtatcacagggaagacagaagatgaaatcaaagcattaagaaaagaatggaatatcaccgctgcttataagatggtagatacctgtgcagcagagtttgcagcagaaacaccatactactatgctgtatatggtggagaaaatgaagcggttggtgagacaacaaagaaaaaagtactggtacttggttccggaccaatccgtattggacagggtatcgagttcgatttctgttctgtacattgtacctgggcatttaagaaggaaaactatgaaactattattatcaacaacaatccggaaaccgtaagtacagactttgatattgcagataaactgtatttcgagccattaacaccggaagatgtagaaaatgtagtaaatgtcgaaaaaccggacggagcagtggttcagtttggtggacagacagcaatcaaattgacagaggccttgatgaagatgggcgttccgattcttggaacatctgcagaagatgtagatgcggcagaggaccgtgaactctttgataagattcttgaagagtgtcatattccaagaccgcaggggcatacagtatatacagcagaagaagcaaaacaggcagcacatgagctgggatatccggttttagttcgtccttcttatgtacttggcggtcagggtatgcagattgcaatcaacgatgaagacgtggaacagtatatcggaatcatcaatcgaattgcacaggaacacccgattctggttgataagtatcttcagggaaaagaaatcgaagtcgatgcaatctgtgatggacaggatattttgattcctggtatcatggaacatatcgagagagccggtatccattctggcgacagtatttctgtttatccggcacgtaccatctctgatactgcaaagaaaacaattgaagaatacaccagacggctggcaaaatctctgcacgttatcggtatgattaacattcagtttatcgtatgcggagaagatgtctatgtaatcgaggtaaatcctcgttccagccgtactgtaccgtatatcagcaaagtaaccggtattccgatcgtgccgcttgcaacaaagatgattcttggttacaaactgcgtgaccttggatatgaaccgggacttcagccggaagcaaaacacattgcaatcaagatgccggtattctcattcgagaaaattcgtggtgctgatatcagccttggaccggaaatgaaatctacaggtgagtgccttggtattgctcagtcctttaatgaagcactgtataaagcattcttaggtgccggaattaatcttccaaaacacaagaacatgattatcacagtaaaagatgaggacaaagaagaagtcattccgattgcacgtcgttttgaagctttaggatacaaaatttacgcaacaagaagtactgcaaaagtacttcaggaaaatggtgttcatgccgttcgtaccaataaaattgaacagccgtcaccaaaccttatggatctgattttaggacataaaattgacctggttattgatactccgtctcagggtgtagaaaaagcaaaagatggatttattatccgtcgaaatgcaattgaaaccggtgtcaatgtactgacttctcttgatacagcagaagctttagtaacaagtttggaaaatacagatattcagaaactggaactgattgatattgcgactgtaaaataaacagtgcagaattagaaagaaaaagcggattgtggaaaattggcaatccgcttttctgattttaaaggagacatcaatggattttattgaattactcaaggttatttttctgggaattgtcgagggaattaccgagtggcttccggtcagcagtaccggacatctgattttagtagaagaatttatcaaattaaatgtaagtgaagcattttgggaaatgttcatggttgttattcagcttggagcaatcatggcggtcgtagtattgtattttaaagagttatggccgttccagaatcagaaaaaggcaaagggtgcactggaacgctatgtaaaaaccgataaaatgattatgtggtttaaaatcgtagtttcctgtattccgtccatcgtaatcggtctgccgtttaatgattttattgaagcacattttaataactatctggttgtttcgattatgctgattgtctatggtatcttttttattctaatcgaaaattacaataagaagagaacggcttctatcaattctgttgtagaaatcggatggaagactgcatttttaattggagtattccagcttttagcagtcattcccggaacatcccgttccggggcaactatcatcggaggaattctgcttggaacttcaagaacagttgccgcagaatatactttcttccttgcaattccgaccatgtttggtgcaagcttattaaaactcgtaaaatttggtctgaatttcactggaacagaagccataattctgattgtcggaactttagtttcttttgtggtttcaattctggcaattaaattcctgatgggatatattaaaaaacatgactttaaagtattcgggtggtatcgaattgccctcggtattgtagtgttattattcttttcactctttcgataatcaatatttttctgattcatttaaggtttgttaagatagtttcttgtttttttataaaacggacataattttatcacaatttatctttataataggtttcagatagttgatgaaccactcactatctcccccctcaagtaaaaaaaccggtgcttgcgcatcggtttttttcattctacataaaactttgttccatatagattaaagtgatatcttgcttgcataaatggctaaagagaggtaaaatagaagtattaaaagcatcagagggaaaggggtacttattttatggcaaagaagaaagtagtagttgcattaggacacaaggcattaggtactacattaccggaacagaaaagtgcagtaaagaaaaccgctgcgattatcgcagatttagtagaagcaggtgcagagctggttatcactcacagtaacgcaccacaggttggtatgattcataccgcaatgaatgaatttggaaaggtacattcagactataccgcagttccaatgtctgtctgctcagcgatgagtcagggatatattggatatgatattcaaaatgcaatccgtgcagaactgcttcgacgtggtatttttaaaccggtcagcacaattattacacaggtcacagttgacccgtatgatgatgcgttccatgaaccggtgaaagtaattggacgagttttgacagaagaggaagcagaacttgaagaacagaaaggaaactatgtcacaaaagtagaaggcggttacagacgaattgtagcagctccgaaaccacaggacgtagtagaaattgatgcaatccgtacactctccgatgcaggtcagattgtaattgcctgtggaggcggtggaattccggtcttagaacagcaggcatctttaaatggagcaagtgcagtaattgaaaaagacctggttagtggaaaactggcagagctcttagatgctgaggaacttttaatccttacaagcgttgagaaagtttctttaaattatcagtcagataaagaagagaagattgaaaaaatggatgttgaaactgcaaagaaatatatgcaggaaaatcagtttggggcatctacaatgcttccaaaagttgaagcagctgtcagctttgtagagaaaaaagcaggaagaaaagcagtgattacctcgattgaccgggcaaaagacggtttccttggaaagaccggtacagttattgagtaaaactttttgcagtaaaaagaaaagaccatctccgaaggttaaaaaggggatggctttctttttgctatgtgacttgcttaagaagtacggtttatgttatcctatataccataccagaaataaaaatccttttgaaaggagagatagaaaatgatgaagctatcacaattattagaacagattgaatatacatgtgttcagggaggtctggacaaagaaatcaagagtgttgtttatgattcaagaaaagtgacaccggattctttatttttatgtattaaaggcgcagtgtctgatggacataaatatgcaaaagaagttgtagaaaaaggtgcgacagtacttgtcgttcaggatgaagtagaagtgccggaagaagttaccgttatccgtgtggaaaatacccgttatgcgatggcatgtatttcagcagcatggtttggacatccggccgaaaaaatgaaagtcatcggtattaccggaacaaaaggaaagacaaccactacttatctggtaaaatctattcttgaaaatgcgggatataaagtcggattaatcggtacaattgaggcaattatcggagatgaagtcattccggctgcgaacactactccggagtcttatattgtgcaggaatattttgcaaaaatggcagaggcaggctgtgactgtgttgtgatggaagtttcctcacagggtttgatgcttcacagaaccgcaggttttgtatttgattttggtatctttacaaatattgaaccggatcatatcggaccaaatgagcataaagattttgatgattatctgcattgcaaaggattgttatttaaacagtgtaaagttggaattgtaaatgccgatgatgaacatgtacagcaagtattggaaggacatacctgtacggtagaaacttatggtttgcatgacaatgcagatttatgggcaaaagatttaaaattagtgactggaaaaggtgtgcttggaattgactatgaagtacagggattgatggatttcccggttgaaatcgacttgcccggaaaatttagtgtctataattctttgacagcaatcgcaatttgccgtcattttggagtttccgaggagaatattcagaaagccttaagagctgcaaaagtaaaaggtcgtattgagatggtaaaggtatccgatgaatttacactgatgattgattatgctcataatgcgatgagtcttgaaagtcttttgacaacattaaaagaatataaaccaaaacgtctggtgtgcctctttggatgtggaggaaaccgttccaagttgcgccgttatgaaatgggcgaggtatccggaaaactggcggatttgactattattacttcagataatccaagaaatgaagagccacaggcaattatcgatgatatcaaaatcggaatcggaaagacagatggaaaatacgtggaaatcattgaccgtaaagaagcaattgcttatgcgattcacaatggacagccaggtgatgttattgtacttgccggtaaaggtcatgaggactatcaggaaattaaaggaaagaaatatccaatggatgagcgtgatttaattcgtgacatccttgcagggaaatagaatcagcagaaaatagatgaaaaaatggtatgcagatattattgtagatatttcacaggaaaaattggaccggacgtttcagtatgaaattccgcaaaatttacttggaatcataaaaacaggtacaaaagtagaagtaccgtttggaaaaggaagccgaaccatcagtggttatgtgattgggatttcagataagccgaagatagaagaaagcaaaatcaaacctgtttcaaagatatgggaaaaaggaattgaaattgaatcaaaattaatcggactggcaggatggatgagcagggagtacggctgtacgatgaatcaggcattaaaaaccgtacttccggtaaaagaaaaaaaacagcagaaggaaaccagaaccatttgccttaaaattgaaccggaagaagcgaaagcgctgttagaagaatgggaaagaaaacactataaggcaaaggcaaggctgttagaagcactgcttttaaaaggagtactttcttataccgaggcaacgggaaatttaaaactttccggtgccggaatcaaaaaaatagaagaaagtggtatcattcagattgaaaatcagaaagtatatcgtgatcctgtgcatcgaaaagaaacgaaaaccgttcaaaaacagttaaatgaagaacaagacagggcggtacttgagattttagaagagtgggaaagtccttttcatcgtccggttctgctttatggagtgacaggaagcggaaaaacagaagtttatatgaagctgatagaaacgatacttcgggaaggaaagcaggcaattgtactgattcctgagattgcactgacgtatcagacagtggagcgtttccgtgcctgctttggagagtgtgtgtcttttttacattcgagactttcagcaggagagcgttatgatcagatggagcgggcgaaaaatggagagatttcaattattgtaggacctcgttctgctttatttacaccatttccaaatcttggattaattgtaattgatgaagaacaggaatcctcttataagagtgagaaaactccgtgttatcacgcaagagagaccgcaatcgagagagccagacaagaaaaggcaaatgttgttatgggttcagcgacaccgacaatagagtcttacgaacgtgcaagaaaaggagagtatctgcttgttacattaaagtcccgctatcaaaatcaggtgatgcccgatgtgacgattgtaaatctggcagaggaattaaaggcgggaaaccgctctgtattcagtcagagtttacaggaaaagataaaagaacggcttgaaaagaagcagcaggtgatgctgtttttaaaccgaagaggttataccggatttgtgagttgtcgggcatgcgggcatgtaatgaaatgtccgcattgtgatgtgtccctgacgtctcacaggaatggaaaactgatttgtcattactgcggatatacgattccgaatgtaaaagaatgtccctcctgtggttcgccttatattggaggttttaaagcaggaacacagcagatagaagaacaggcgcatctgttctttccaaaagcgcggatccttcggatggatgccgatacgacaagaagaaaagacgaccatgagaagatcttatctgcgtttttggcacaggaagcagatattttaattggaacgcagatgattgtaaaaggtcatgattttccaaatgtaacgctggttggagtgattgcggcagatttgtctttaaacgtaggagattacagggcttccgagcgtacatttcagcttcttacacaggcagttgggcgtgcagggcgtggcagatttgcaggggaagctgtgattcagacgtatcagccggaacattatagtattgtgacttcggccagacaaaattatgaacagttttttgaacaggaaatcgtttatcgcagtttgatggggtatcctccggcaaaatcaatgctgacgatttcgggcagctcggcagaggaagccttgcttttggagggattaacctactgccgaaaatatattgaaagtatttataagaaaaatgatttattaatcgtaggaccggcaccgcagagtatttctaaaatacaagacatgtaccgtatggtactgcatctgcggcatggaaataaagaaatcttgattaaaattatggaaagactggaacgctatattcagattaataaaggatttgaaaagatttatatccagtttgatatgaattaattgaattgttgtacagcaaagtaattcgcaggcagtagagtaagagattgaatgaaaagaggagtaagaaagacatggcattaagacaaattagagtgcagggagataccattttagaaaaagaatgcagaaaagtagatgaggtaacaccaaaaatccgtgatttaatcgaagatatgatagagaccatgtatgacgcaaacggagttggtcttgctgcaccacaggtaggagtgttaaaacagattgttgtcattgataccagtgcagacggagaaggattgtatgtattaattaatccggaaattcttgaaacatctggcagtcagacaggagaagaaggttgtttaagtgtaccgggcatgtcaggtgtagtgacaagaccggactatgtaaaagtaaaagcttatgatgaaaatatggaagaatttattttagaaggaacagaacttttagccagagctatctgtcatgagacagaccatttacatggaaaactgtatacagaactggtggaaggggaactgcaccgtgtaaattacgaggaggaagaataggaatgaaagttgttttcatgggaacacctgattttgcagtcggaacattggaagagatcgtaaaagcaggacatgaggtggtggcagttgtcactcagccggacaaaccaaagggcagaggaaagactttaatgccgacgcctgtaaaagaagctgcattaaaatatgcaattccggtctatcagccattaaaagtaagagcagaagagtttgtgaaagtgttagaagaaattgcaccggatatcattgtggtagctgcatttggacagattatttcaaaagaaatcttagaactcccaaaatatggatgcatcaatgtacatgcgtccttgctgcctgcctatcgaggagcagctccgattcagtgggctgtcattaatggcgataaggaatctggtgttaccattatgcagatggatgagggactggataccggtgatatgattgataaagtggttgtaccgattgaaaaagaagaaaccggtggaagtctgtttgataaattaagtattgccggagcaaaactctgtgtaaaagtaatggctgatttagaagcgggagtggcagggcgcattcctcagccggaagaaagtactacaccttatgcgaaaatgattagtaagcagatggggaaaattgactggaatcgtccggcaaaggagattgaacaattagtacgtggattaaatccatggccgagtgcatataccagtatgaatggaaaaaatttaaaaatctggagtgctgaagtattagaaaaatcagaagcggatgaggcacagacaggacagattctgcgtgcagataagaatggacttcttgttcagacaaaagagggctgtttaaatatcaaagaattacaattggaaggaaaaaaacgtatggatacggcttcttttcttcgtggatacccggtggatacaggtttgacattaggggataagtagaatggtggttcaggtaaatacgagagaattggtattgcagacattgcttgaaattaataaagaaggtcagtatggacatattgcaatccgcaatacactggaaaaataccagtatttggaaaaacaggaaagagcatttattacaagagtctgtgagggcacacaggagaatcagattaaaatcgattatatgattaatcagttttcaaagattaaagtcgaaaagatgaaaccggtgattcgcgaaattttaagaagcagtgtctatcagatgttttttatggattcgattccggataatgcagtttgtgatgaagcagttaaattaaccagaaaaaaaggattctataatctgacgggttttatcaatggtgtactcagacaaatggcaagaaggcgaaagagtattgtattcccggaaaaatcaaatgagaaagaatatctttcgattgaatattctgtaccggaatggatggcagaaaagtttttaaaacagtttggatttgaaaaaaccgagaagattttggcttcttttatgcaggagagaccgcttaccgtgcggatccgcaagtctgagattaataaagaagaagtactggaaagcttaaaatcagaagggatacaggtagaaaaagctccttatctggaaaatgcgtattatttaagcggatatgattatcttccggcgttagaagcatttcgtgccggaaaaatacaggttcaggatgtcagttccatgctggttgctgaaattgccggcataaaagcaggagattttgtagtggatttgtgtgctgccccaggaggaaagacccttgcggtggcagacaaattaaatggaacaggcaaggtgagttccagagatgtcagtcagaaaaaagtagaattgattcaggaaaatgtcacccgcatgggatttcataatatcgaagcaagtgtaaaagatgcgacggtatttgactcttctatcatggatcaggcggatgttgtcattgcagatgttccatgctcggggcttggagtaatcggcagaaagaaagatattaaatacaatatgactttggaaaaaatcaaatccttagttccacttcaaagagaaattctggaaaaagcagcctgctatgtaaaaccggggggtgttctgatttacagtacctgtacgattaccaaagaagaaaatacaggaaatattgcctggtttatttcaaactatccatataaattagaaagcattgagccttatatctgcgaagaacttcactgtaagacaactaaagacggctatttacagatgcttccgggaatccataagagcgatggattttttatggcaagacttaggagggtggaataaagatgcagaaaacagatattaagtcccagactcttgaggaactcaaaaacaccgttttggaattgggagagaagccatttcgtgcaaaacagctctatgaatggatgcatgtaaagctggcggatgattttgatgagatgaccaatctctcaaaagatttccggcagaaattaaaagaaaactgtacgttgactgctttaaaaaaagtggaagttcagatttccaagatagatggtacaaggaagtatctgtttgcactttcagatggaaatgtggtagaaagtgtgcttatgcgctatcatcatggaaatagtgtgtgtatttcttctcaggttggttgtaagatgggatgccgtttttgcgcttcgacgattggaggctggacgagaaatctgaccgctgccgaaatgcttgaccagatttatcagattcagaaagattccggcgagcgggtatcaaatgtagtagtaatgggaaccggcgagccactggataattatgattccctgcttcgttttatccgtatgttaagtgacgataagggtttaaatatcagtcagagaaacatcacggtttctacttgtggaattgtaccgaagatgtatgaacttgcggaagaaaaacttcagattacactggcgctttctctccacgcttcgagtcaggaaaaaagagaagaattaatgccgattgcaaacaagtacagtctggatgaagtacttgatgcatgcagaaattattttgaaaaaaccggcagaagaatcacatttgagtacagtctggtgggcggaaaaaatgattccgaagaggatgcacagcgtctggcagaactgataaaaggtttaaactgccacattaatctgattccggttaacccgattaaagagcgaaattttgtccgctcagaaatgaaagttatcttaaattttaaaaataaacttgaaaaataccaaattaatgttactattagaagagaaatgggtcaggatattgacggggcctgtggacaattaagaaagagttatatcgataacaaagaggattcgtaagatgaaatcatattctattacagatgtgggccagatacggacactcaatgaggacttcgtatttgcctcagatacccctgtgggaaatctgccgaacctcttcgtagttgcagacggaatgggtggacacaatgcaggtgatttcgcgtcaaaatatgcagtggagacactacttgagacaatccgtgttaatcctgagaataatccaattaaaatcatccgtactgcgattgagactgcgaacagttctatcttaaaagaagcggcagaacatgagacaatgagcggaatgggaacaacgatagttttgacaacaattgtaggtgattacgcttatgtggcaaatgtaggagatagtcggctgtatctgattaacgacgagaggattattcagattacaaaagaccattcactggtggaagaaatggtgcgaatgggcgaaatttccgaggaagatgcaagaaatcatccggataaaaacgtgattacacgggcgcttggtgcaacaaaagatgtagcagtagacttctttgacgttcatttagaaccgggagacaggcttctattatgttccgacgggctgaccaatatggttttagatgaagatatagaagacattattgtttctgaagaattgcttgaaactgccggtaaaagactggtagaagcggcgaatgaaaatggaggcaaggataatataggaatagttctggtagaaccagacacaaaagaggtggaagtatgttagatgtgggagttattgtaagtgaccgctatgagattgtgggttgtgtcggctccggtggaatggcggatgtatacaaagcgaaagatcataaactgaatcgttttgttgcaataaaggtattgaaagcagaatttggttctgatacaacctttatcagtaagtttcaaagagaagcacaggccgcagcaggtctggcgcatccaaacattgtaaacgtgtttgatgtaggagaagataatggcattaattatattgtaatggagctggttgagggaattaccttaaaagagtatatttccaaaaaaggcagactgacgataaaagagacaaccagtattgcaattcaggttgcaatgggacttgaagcagcgcacaataaaaagattgtgcatcgtgatatcaaaccgcagaatattattatttctacggatggaaaagtaaaagtaacagattttggtatcgcaagagccgcttcttccaatacaatcagtaccaatgcaatgggttcggttcattacagttctccggaacaggtacgtggcggttacagtgattataagagtgatatctattcattaggtatcacaatgtatgagatggtgacaggaacggttccttttgatggcgatacaactgtttctatcgcaatcaaacatcttcaggaggagatgataccaccgtcagaattaaatccacagcttccacacagtctggaagaaattatcatgaaatgtacccagaaaagtccggacagacgatacaattcactggcagagttgatcagtgatttaaaacagtctttgattgatccggacggaaatttcgtaaatctgactccactgagtaatcatgcgcagacggttgtaatctctccggaagagatggaacagattaaacgaggtgcagtggcagcaggaaataccgtgccggaaagtaatccggaagtaaattatgaagattttgaaattccggacgaagatgaatatatcgacaacaacgcagattatgattataaagatgatgtagatgactatgatgcagaggaagaagaaccacacaaaaaaggaatcagtcatacattggaaaaggtgatgacaattggtggaattgtggtaggagcaattattatctgtgtcttagtttacacaatcgcatcagcttcgggcttattaaaattcggttcctctaaaaataataacagtgggaatacgacggcttcagacagtaaatcagaaaaagattcagacagcagtgtaaaacaggtggaagttccggatttaacaaacaagacaccggaagaagcacagaaaacattaaatgacttgcagttagggtataagaatggcggagaagaagcatctgacagtgtagcagagggaaatatctgccgtcaggatgtagaagtaggaacaaaagtagagccgtatacacagattacctgttatatcagcagtggaacagaagaaattcaagtaccgtatgtgactgactattcacagacagatgcagaagcaatgttaaaagaattaggcttaaagacagcggtacagaaagcaaacagcagtgacattacaatcggaaatgttgtttcaactgacccggaagccggaacaagcgtaaaagccggagatacggtaacgttgactatcagtatcggagaaggagatactgcagtacgtgtgccaaatgtgattgggacaagtgaagcggatgcaaagagtaccttaagtcagctgggacttcttgtaagcgttcagacaggaaatgaccagtctgtaaacgaaggagaagtttataaacagagtgtggacagcggaacgagggtaaatacaggagaaacgattacaatttatgtaagaagcagcagttcttcggatgacgaagacagtgaggacagcaagacagataaagataaaaataaaaataaagataaagataaaaattccagcagttcctctgatggaacatggaagcctgcaaacagccttcagcagccgaccaattatcagggtggaaaagtaaaagtagaactggtacagacagatgatgatggaaatacttattcggaccagtcaatggaagtggacgacccacagtttccgttgtccattcaggatttaaatggtcatcctggaattacaagcggaactgtagtgctgtatgaatggattgatgacagctatcagattattgaccagtatgatgtttcttttaggcaggtaaattgatgattggaaagattatgaaagggattgccggattctactacgttggtgtagcagaatccggagtctatgaatgtaaagcaaagggaatattccgaaaagataaaataaaaccccttgttggggatgatgtggaaatagaggtcctgaatgaagaggagaaacttggaaatatcgtaaagattcttccaagacgtagtgaattgattcgtccggcagttgcaaatatcgatcaggcattggttatttttgcagccagagaaccaaagccgaatctctctttattggaccgctttttagttatcatggaaaaacaggatgttcctgtgattatctgttttaacaaacaggatttatgtgacgaagaagaagttggacgtctcaaagagatttatgaagcctgtggctatccggtggtgcttgcaagtgcaaagcagggtgaggggattgaagaaattaaatcactgcttcgtgggaaaacgacaacagttgcaggaccgtccggagtgggaaagtcttcattgacgaatctgcttcaaaatgaggtgcagatggaaaccggggaaatcagtaaaaaattgggaagaggtcgtcatacgacaagacattcacagatcattcagatagaggaagatacctggctttatgacacaccaggatttacctctttttatgtagaagaaatcgaaaaagaagaattacgtttttattttcgagagttttttaaatacgaaggaacatgccgttttcagggctgtacacatacgcatgaaccaggatgcatggtaaaaaatgcattggaagaaggaaaaatctcaaaagaaagatatgaaaattatcttgaactctatggggaattaaaagaaaaaagaaggtattaggagggacaatatgtatcagttatcgccatcaattttatccgcagattttatgaagttaggggaagaaattaaaaaagtagaagaagcgggagtcgaatggcttcatattgatgttatggatggaatatttgtaccgagtatttcattcggaatgccggtgatttcttcagtcagaaaaaaatgcagtctgtttttagatgtacatcttatgattgaagaaccggctcgttacatttcgcagtttaaagcagcgggagccgacatgcttaccgttcatgcagaggcctgtaagcacctggacagtactctttatcatattcgggaagccggaatgaaagcaggggttgcaattaatccggcaacaccgctttgcgtagtggaagaggtacttggaattgttgatatggtgcttattatgacagtaaatccaggatttggagggcagaaatatattccgtatacgacagaaaaagtaaagcggttaaaagaaatgctgaaggacaaaaatctggatgtagatatcgaagtagatggtggaatcagtaagaatacaatggatctggcattggatgcaggagcaaatattctggttatgggttctgcgatttttaatggagaggcaaaggaaaatgccatgatgtatcagaatcggttggaggcttatgaacatgaacacagtgctgatttgcggcggtgaaatcaatgatgagtttagcttagtctgtttaaagcagataaagccggactgtattatcggggtcgataaaggattagaattttgctatcgaaatcatgtcattccggattggattttaggcgattttgacagcatttccaaagaggtgatagactggtatagagaacagcaggaaattccgattcgtcagtataaaccggaaaaggatgataccgatgccagacttggaatggaactggcactaaagttgggcagtgataagatttttctgcttggggcaaccggaggaagattagaccattatatgggaaatcttcagtcgctcttaattacggcaaggaaagaaaaagaaggctggattttagatgagcaaaatgcaattacggttagaagagcaggaaaaatttgtattcacaaagaagaacagtttggaaaatatgtttcgtttttctctatgggagatgaagtgacaggattgtctttaaccggattccagtatccgctggatggttacactctgaaaaattcagatggaatcgcagtcagcaatcagttgttggatgattgtggtattatagaatttgagaccggttatctgatgatggttttgtcgaaagatagaacaaaatgttgataaattttgaaaacagctttaatctgaaataggattaaggctgttttttgattttagcagaaaatagcagacttcttgcaatctaagaatttactttttggatttgttatgctatagtatagaatgagtcttggggctcttttcaaaagaatcaggagatgttcctgttacaatttagtggtgaaaacccataggcttgcctgtggaagtagtcagtacataggataaaatagaaaaatacaaaaaatgtatgattggattctttttatcagacctaaagagagtttaaatctacatgggatagattgaaggaggagatacaagaaatgaaattaggaattgtgggattgccaaatgttggtaaaagtaccctttttaattctttaacgaaggcgggcgcagagtctgcgaattacccgttttgtacaattgacccgaatgtgggaattgtaactgtaccagatgaacgtctgaaactgcttggggatttttatcattccaagaaagtaacaccggcagtcattgaatttgttgacattgcaggtctggttaagggtgcttcaaaaggagagggtcttggaaaccagtttcttgcaaatatcagagaagttgatgcaattgttcatgtagtacgttgttttgaagatgaaaatgttgtacatgtagacggaagtattgacccgcttcgtgatattgaaaccattaatctggaactgattttctcagatattgagattcttgacagaagaattgcaaagacaacaaaaactgcacgtatggataaagaagcagcaaaagaactggaattattaaagaaattaaaagaaaccctggaagaaggaaaaccggcatctgtatttgaaccggaaaatgaagacgaagaggcactgttaaaaggatacaacctgctgacaggaaagccggtcatctatgcagcgaatgtttcagaagaagatttggcagatgatgccgtttctaatccacatgtacagaaagtaagagaatatgcaaaagagacaggcagtgaagtgtttgcgctttgtgcacagattgagcaggaaatcgcagaattagatgatgatgagaaaaaagaatttttagaggatttgggaattgaaaaatccggattggaaaaactgattgtagcaagttatcgtctgcttggtctattaagctttttgacttcaggagaagatgagacaagagcatggaccattaaagtgggaacaaaagctccgcaggctgccggaaaaatacataccgattttgaacgaggatttattaaagcagaggttgtaaattatcaggatttattggattgtggttcttatgcgggcgcaagagaaaaaggacttgtgcgcatggaaggaaaagagtatgtggtacaggatggcgacgtaatcttattccgctttaatgtataaggaggaaaaatgatatggatatgtccattcgtttcccacatttgggaatttatctgccgaatgtaggaaaaacaatatcagtctttggatttgatattgcatattatggaattacaattgcaatcgcaatgattgtgggaatctccattgctctgcatgaggcaaaacgtaccggacaaaatcaggatacctatttggatttactgatgcttaccatgcttacttcagttgttggagcaagaatatactatgtcattttttcatgggataattataaggataatctgggcgaaattttaaatatcagaaatggcggtcttgcaatttatggaggaattatagccggagctattacggtttttatttattctaaaataacaaaaatgaaattcttacaaattgcagatactgtatgtatgggactggcagcaggacagattatcggacggtggggtaatttctttaaccgtgaagcatttggagaatatacgaataatctcctggcaatgcagcttccggtatccgcagtgcgcaaaaatgaaattacttctgctatgtggaaccatgtagtaacaatcggtggagtggaatatattcaggtacatccgacttttctatatgaaggactttggagttttatggttcttctgtttctattctggtttcggaagcgaaaaaagtttgaaggagaacttttcttctgttatcttgcaggatatggagctggtcgtttctggatagaaagtctgcgtacagaccagctgcttttgccgggaatccatgtaccggtttcccagatgctttcagcagtgttggttgttgtttcactttcagtgattatttgtaaaagaagaaagaacagggagtgtcgttatgacaaaagaaaccttaaaaatacagattgaggacacaagaaaatacttgaatcagagtataactgaaaaacagagtgcagataagattctggaaatcagtgtaaaattagataagttgattgaagaatatttaaatacaaaagaataaaacaactgttcgcaaaattgaatgggaagaagaattaaaatgccgcaaatcttttgatattgcggcatttttcgagaaaactcagacataaggggaatatatgttccccttgctttttttacagtggtagtatagaatggctttgtaagtggtaagatgtggtgaaagtgacggtaaataggggacttatggcagaagtcacagttatttccgttaaaaaacagaagaaagaagcatatttttcacccgaaaaaacagaaaaaattactactttttgataaaatgcaagaatcttctcacgtttcttcgtttcagagcaggccgatagtgaaccggacaagcaggggagaattctcgcgccggcaaggatgcgggagtttgcgggtctaagatattcaagtcaaatgcttatgagacttaaaaataccgtctggaaacctcgcccgaattgcaagtgaatgacaggagggtcaggagaatggaatttaaacacaaatccgtcttgttaaacgaaacaattgagaatttaaatattaaaccagatggaatttatgtggacggaacgctgggaggagctggacattcttatgagatatgtcgtcagttgtctaccaaagggagtttaataggtatagatcaggatgaggctgcaatagaagctgccagtaagcggttagaagaatttcaggaccgtgtgacaatcatacgcagcaactattgcaatatgaaaaaagaattaaaccgtaaagggattttttctgtagatggaattgtacttgacttaggggtttcttcttatcagttagataacgcagaaagaggatttacatatcgggaagatgtgcctcttgatatgcgaatggatcagagaggaagccggactgcaagggatattgtcaatgaatacagtgaacaggaattatttcgtgtaatcagggattacggtgaagataaatttgctaagaatatagcaaaacatatatgtacagcgagggctgtgaaaccaattgaaacgacaggagaattgacagagattatcaaacagtcgattccgatgaaaattcgtgcaacgggaggacatccggcaaagaaaacatttcaggcaatccggattgaactgaatcaggagcttgaagtattaaagaactcattagatgatatgatagaactgctgaatgatgaaggacgcatctgtattattacgttccattcattggaagaccgtattgtaaagacaattttcaaaagaaacgaaaatccctgtacctgtccatctaattttcctgtatgcgtatgtgggaaaaaatcaaaaggaaaggtaattaccagaaaaccgattcttccgtctgaggaggaattagaggaaaacacccgttccaagagtgcaaaattaagggtgtttgaacgtatcaggcaggaataaaaagtagataataaggtggcatcatgagcagatataagatagatggaaatactgcacgccgcgaaaatgagagccagcaaaagaaaaataaaaagaaagtgtcagtcagaaatcagaaaaaacagaagccgaaattgaatcgtaaatttgtatacagtgtacttgcaggttgtattatggtaaccatggcgagtacacattatcttcaattaaagtcagaaatggcaattcagaaaaaccggctgacctctcagaaattagaatatagtgagttaaaggcggataatgatgcgtactatagcgaagtgctttcaagtgtagacttggaaacgatacggaaaaaagcattggatgaatttggtatgaagcatgcgaccgaggaccagattaagtattatacgccggacggtgatggctatgtaaggcagtatcaggaagtaccggaagagtaagagcgaaggcagagcaggtggcagtttgaaaagacaacaaaaaaaaggaacaaaaagacttacaaagaaaatgaaaacgaagctggtgggattactgattgtaattctgctggctttagtcgcgttaatatttcggattacttatatcagtattaaaagcggtgacagatatacaagacaggtattaacccagtcccagcagcagtatgaaagtacgacagttccatttaagaggggcgatattctggatagaaatggcaatacccttgcaaccagtgtgaaagtctataatgtaatcttagattgcagtctggtaaattcagataaaaaatatcgtaaaccaacagtggatgcattatcggattaccttggaattgacagcagtgtggtagaagcaaagctggatgatgaatcgacagcaaattcgcagtatcaaattttaaaaaaagtatctatggatgaaagaaaacatttccttgaaatgaatgaaattacggatgataataaagataccttaaaaaggagcgaatacaaacgcagaagcagagtaaaaggggtctggtttgaagagcattatcagagagagtatccatttcatgcactggcaagtacggttataggattttcatcggtgaataatacagcaagccttggaattgaggggtattatagcagcaccttaaatggcacagatggaaaaaaatacggatatttaaacagtgatgacatcatggagcagaatattgtagatgcagtagatggaaagacagtggtttcgacaattgatgtcaatattcaaagtattgtagaaaaatatatttcagcctttaatgaaaaattaagaaacaatgcttatgaaggagacggagcagaaaatatcggagttattgtagaaaatccaaataatggtgaaattctggcaatggcagggaaaaatacctttgatttaaatgacccgagagccgcctatgcgaaccggacggacttatccgatgaggagatcagtgccggattagatagtttatgggaaaatttctgtgtctcatcaaactatgaattaggttcggttatcaaaccgattattgttgcttccgcattagaatccggagcagtcagtgacagtgatgtctttatctgtgatggtggagaacagattggaaatgattatgtacgctgtgcagtttatccttatgcacatggaacggaaacacttggagaggttattcagaactcctgtaatgacggcatgatggcaatcggacgaaaaatgggagcggctttattgttggattatcagtcacggtttaactttggaagccggaccggaattgacctgccaaatgaaagttcaggagcaatttatacgcttgaccagatgaaagatatggaactggcatctacaacatttggacagggatttaccagtaccatgattcaggaaatttcagccgtgtctgcggtaatcaatggtggaacttattatcagccgcatgtggtaaaagaaatcaaatcacaggaagatggctctgtattaaaaaccaatgaaggaaatgtattaaaacagattgtatcttcagatgtttctgaaaaaattcgtgagtacatgggaatgagtgtaacatctggaaccagtagaaaatcaaaagttcagggttacagcatgggtggtaaaacaggaaccgcagaaatcttaagtacaaaagaaaaagattatctggtttcttttattggatttgctccgcttgatactcctcaggttgtggtttatgtagtagtggatcgaccaaatgtagaagaacaggcagacagctcttatgcacaatatattgcacaggcaattttggatgaaattcttccttatatgaacatttatccagatgaagagacagaagaaactacaaaattatgggatggttttaaaggtgttttaaaactggatgattctgaagtagaagtagatgagccggccgtacagacagaaggttctgaaaccggaaccgataatgctccggatatcgaagttgtacaggatgaaagtggctcatcagaagaatataatgatgaagaaagtgacggcgtagcaagtgagaatgtcggatatgaggaaaatgattctgaagatgtgtctgacgaagaggatacttcaagcgacaattttgaagaagatacctcgaaccaagatgactacgaagaagatgagggagaataatagagcctctcatttaaaatagtgagatttaagctaaaaaggaatcctgcaagatgggattcctttttgttgtctgtcatatatataaaaaaaacaggttcaggcagatgaataaaaacagagtctatcacaaaaagaaaacagtaatcgtattctttagctgtctttttttattaacaggtctgatcgtacgtatggtttaccttatggtcattgaatcggattattatgcaaaaaaagcacagactcttcatgaaagagaacgtgacattaaggcagaaagaggaaaaattattgatgcaaaaggagaagttttagcagataataaggcagtctgtacgatttctgtcatacatagtcagataaaagagccggaaaaagtgattgaaatgctgaaaaaggaacttggactctcagaggaaacagccagaaagcgtgtggaaaagcgttcttccatcgaaagaatcaagacaaatgtagagaaagagacgggagaccggattcgggaatatggtctggatggggtaaaagtagatgaggactttaaacgatattatccatatcaggaacttgcttcaaaagtacttggatttacaggcgcagataatcagggaattattggacttgaagtacagtatgatgactttttaaaaggaacagatggaaaaattctcacggttacggatgcaaggggagtggaactggaaaaactgggagagagccggatagagccaattgccggatatgacctgcatgtcagtctggataaaaatattcagatgtatgctcagcaggcagcagaaaaagtaatggaagaaaaagaagcggatgccgtctcaattttatttttaaatccacagaatggagaaatctatgcggacgtcaatgtaccggaatttaatttaaatgaaccatttatgttaggggaagcagaggaaaacttaaatcaaaaagaaaaacaggatgccctgaaccgaatgtggagaaacttaacggttaatgacacttatgaacctggttcgacatttaagataatcacaatggcggcaggtttatcagaaggtgtggtgacaccaaatgaccgtttttcctgtcctggttttaaagtagtggaggatagaagaattcactgtcataaaagaagcggacatggggcagaagattttgtgcagggcgcaatgaattcctgcaatccggtttttattgaagtaggactcagacttggggtagaacggtattatcattattttaaacagtttggtctgttaaaaaagacagggattgatattccgggtgaagccggaacaattatgcataaagaagcgaatatcgggcaggtggaactggcaacgatttcttttggtcagtcttttcagattacaccgattcagcttgtaacaacagtcagttcgattataaacggaggaagaagaattacgcctcattttggagtttatgtgacagacgagacaggaaaagaggtaaagcgatttgaatatccggttgaaaataatattgtgacagaagaagtttcaaaagaagtcagagaaattctggagaaggttgtgtcggaaggctctgggaaaaatgcatttattgaggggcataccattggcggaaagactgcaacatcgcagacccttccaagaagtgagaatcgctatatttcctcttttcttggatttacaccggcagatgaaccggagattataggaatctgtctgattcatgacccaacaggtatttactatgggggaacaattgcggcacctgtaattcgggatatctatgagaatattcttccgtatcttgggattgaaggttgataaaaaaagcaaaaggcattatactactatagaaagaattgccggatgtttataaaagatagactttcggcaaaaaaatacaaagaagaggtgtattatggcagagtataaaatggtttggccagtcttgattgcatttgcaatcagtgtaattttaggtcctttcgtgattccatatttgcggaaactgaaaatgggacagacagagcgtgtagatggggtacagtctcatctgaaaaaagcaggaactccgacaatgggaggcgtgatttttctcttatcaacagttatcacatctttattttatataaaagattatccaaagattattccggttttatttttgacactgggatttggaattattggatttttagatgactatttaaaagtagtgctgcgtcgttcagacggtctgatgccaggtcagaaaatggcatgccagattgttgtaactgcaattttcgcattttatattatgaaatttaccgatgttcagatgactttaaaaattccgtttgtatccggttatgagttaaatgcaggaattttaaccgttccgctgttattctttgttgtaatcggcactgtaaatggagtaaactttacggatggtctggatggacttgcttcttctgttacgattatggtggctacattcttctccgtcatcgcaattgcaacaaagagtggaattgaaccgattacctgtgcggtagtgggagctttaatgggatttttgttatttaatgtatatccagcaaaaattttcatgggagataccggttctctggcactgggaggatttgtagcaggtactgcttatatgttacagatgccgttatttattttgattattggttttatttatttgttagaagtagtatctgtcattttacaggttggctactttaaaatttccggtggaaaacgaatctttaaaatggcaccaatccatcatcactttgaactgtgcggatggtcagaaaccagagtagttgcagtattctcaattgtcacagcaattttgtgtatgattgcacttttaggtgtgtaaaaagaaaggaaggaaattatgaaaaagacagaattacaggggaaaaaagtattagtcttcggttccggaatcagtggaatcggggctgtaaaactgttagaaacggtacaggcagatgttgtattatatgatggaaatgaatcattaaagaaagaagaaatcagagcaaaacttccgaaagaaagcaaatgtgaaattgtacttggagaattaaaacaggaactgattgacagtctcaatctggtcgtgatgagcccgggagttccgcttgatattgaaccggtagaacgcttaaaagcagcagggcttccaatttggggagaagtagaacttgcatactgcatgggggatggaacagtccttgcaattaccggaacaaacggaaagacaacaacaaccgcactccttggagaaatcataaaggcttatgcagattcggtatttgttgttggaaatattggaaatgcttatacaggagcagcttcttccatgaaagaagaaagctatacggtagcagaaatcagcagtttccagttagagaccatacatagttttcatccaaaggtttctgcaattttaaacattacagaggatcatttaaatcgtcatcatacgatggaagagtacattcgtgttaaagagctgattgcttctaatcagaccaaagacgatttttgtattttaaattatgaagatgaggaacttcgtaagtttgccccaaaatgtccggcaactgtagtctttttctccagtgttcagaaacttgaagagggaatcttcctcgatggagaaaatattgtatggaaatcaaaaacagaagaatttgtatttgcaagaaccgatgaattaaaattgcttggtcgccataatcatgaaaatgtaatggcagcttccgctatggcatactgcgcaggtgttccaaaggaaactattcgcaaagtgattatgcgttttactgctgttccacacagaatcgaatttgtagaagaaattaatggagttgcttattacaatgactctaagggaaccaatccagatgctgcaatcaaaggaattcaggcaatgaaccgtccaacgctcttaattggaggcggatatgataaacagtcctcttatgaagaatggattcaggcatttgatggaaaagtaaaacagttagtattaatcggtcagaccagagaaaaaattgaaaaaacagcgcatgaatgtggatttttcaatacgattctggctgaaaaccttgaagaagcagtaaaaatctgtgccgaaaaagcagaagccggagatgcagtactgctttcaccggcatgtgcaagctggggacagtttgataactatgagcagcgtggagataaattcaaagagtatgttcgtgcaatgctttaattgacgttgtcgtagagacaattcataaataataaaataaaatcatatagtgcaatatgagaaaaacaaaaaaggaaatgcttatggaagccgtaagagaaccaaaaaagagtatggacagcatacttttgtttctggtacttctgctcgtcgtgtggggcttgattttcttgtatagcacaagtgcatataatggcagggtgaagtttcatgaccctgcctattattttaagaaacaactttttgccacgtctttagggctcatagcgatgtatttggtttcctgtatcgattatcatattgcggtgaaatttgcccctcttttttatctggcatcaatggggctgtctttggcagtgcttttgtttgggcaggagtataatggttcaaaacgatggctgtcaattggaccgttttcatttcagccgtccgaatttgcaaaagcggcagtgattttatttcttacatttcttatcacaaattcacagaaaaaaaaggatggtatcttttggatggcaggaattatgctgccacttttgccgattgtaggattggttgggacaaataatttgagcacagcaattatcattcttggaattggcgttattttagtttttatttcgcatccgcgttatcttccatttattggaattggggtggcgggaacggtatttatcgctatttttctcggggcggcgagttatcgtctggagcgtcttaaaatctggagaaatccggaagcttatgaaaaaggatttcaaaccattcagggactctatgcaatcggaagtggagggatttttggaagtggacttgggagcagtgttcagaaacttggatttgttccagaagcgcaaaacgacatgattttttcaattatctgcgaagagaccggtctgtgtggtgcagtgctgctgataatgttgtttgcacttctaatctggagattgatggtaattgcaacccatgcaggggatttagaaggagcattgatttcgggaggaattatggggcatatcgcaattcaggttattttaaatattgcggttgtgacaaatacaattccaaataccggaattaccctgccctttgtcagttatggagggacttctgttgtatttttactgggagagatgggaatggcgcttgcagtcagccggagaggaaagagggagagcaggtagcattttaagaaacggtgcatactataggatatagagagcgacggaaggaagaggcagatttgaatcaaatccgtattgagggatttcatcgtctgaatggagaagtaagaatacagggttctaaaaatgcggcattgccaatgatggcggccgctgttttatgtaaaggagaagtgattcttcatcattgtccggatatcacagatgttcatctgatgaaagaaattataaaggggcttggtgggaaggctttttataaaaatcataccatgtatctggattgtacaaagatagagcggactacaattcccaaaaaagaagcagagaagatgcgttcttctattgtgttaatgggaagtcttttaggaagaaaaaaggaggtctgtattccctggccggggggctgtgtgataggaaaacgtccaatcgatcttcatctgtctgcccttgaaaaaatgggagcagaatttacagaagaagacaggggacttaagggaaaaacagaaggactcaaaggcgccagaattgtatttccaaaaatcagcgtgggtgcaacgcaaaatgtaatcctggcatccgtacttgccaaaggtacaacgatactggaaaattgtgcctgcgaaccggaagtgcagtggctgtgccggtttttaagaaaaggtggagcaaaaataaaagaaacgaaaaatcgaatgattgaaatcgaaggcataaagtctttacatgcagttgaatacgaagttccgccggatagaattgtagcaggaacgtatctttgtgcttctgcaattacaagaagcaatatttgtctggtcggagcaccaaaagatgagatgaaagcaatcttatcgctctatcagaaaatgggtggacaatacgaatggattggtggtaaactgtctttgtgcagtcaggaagtaaacgttccggttttatgtcaaaaaacggaagtttatccgggatttccaacagatttacagtcaccggttctggcagtgctttcaggtattaaaggaaaaagctgtctgatagaaaccatttttgagaatcgttttcgtgtagcaggggaacttaaaaaaatgggagcaaatatccggattgatggagcaaaggcagaaatttatggaggaaaactgcatggggcagaggtagaagcgcaggaacttcggggaggtgcggcactggttctggcaggactggcggcaaaaggagtgactacggtaaagaatatcgaatatatcgagcgtggatatgaggatatctgccgtgatttgagtcagcttggagcagtgatggaaagaaaataaaggggattattttatatggataaaaagaaacgcacgaagattttgggcggtattgtggcagtgctgttgcttggaattgctgtttttttcggcggttttcgggttacaagtgtaaaagtagaaggaaatacagctcatacagataaagaaataaaaaagatggtgcttcaaggatcacttgcttcaaataccatactggttcgttttttaaatccgagcgaaaaaacaaaagatgaccagtttattcagaaagtatggattgagcggacaagcagtcataaattaaccattcatgtaagggaaaaagaattaattggttatacgaaatttttggatggatatctgtattttgacaaagaaggaattgttcaggtaagtactacaaaagaattgaaaaatattccatttattgaaggattaggccagaaaaaggttcaggtaggacagaaattgtccggactaacagatgaaattctgggcatgcttttaagtgcaacaaagatgatggagagtagtgaacagcatccggaccgaatcgtcattgaaaatggagcacttaccatgtatttttcggaaatcgaagtaaaacttggcacggaaaaaaatatttcagataaaataagcaaaatgctgggaattttgccacagcttgaaggaatgcagggcgttttggacttacagaatgtggactccacgacagagaccattgtatttaagaagtcagagacacaaaagagcacagaagaaaatcaaaatgagtagaggcagtaaagtaaaaaataaaagaatggaaaaataaaaaaatcggtgtcgaagaaaaaagaaactataagaataaagtaaaaatttaaattttttatgaaaaaatgaaaatagcggttgattaatttttgaaaagaagatattatatatctatatgcacgaaccttggaggagaataggatttggcataagcgtaaaatcagaagaaatacggaatgcaatacatgaaagtgtatttaaaaaccatacaggtaagctaaaggaggaagtactttgttagagattatgacaaacgaggctgaatcatctgcaaaaatcgtagtcattggtgtaggtggagctggtaataatgcagtaaacagaatggtggaagaaacaattagcggtgtagaatttgttggagtgaataccgataaacaggcgctgacattatgtaaagcaccgaccgttgttcagattggtgaaaaactgacaaaaggtcttggtgcaggagcaaaaccggaaatcggtgaaaaagcagcagaagaaagcatcgaggaaattaagcaggttcttcagggtgctgatatggtatttgttacctgtggtatgggtggcggaaccggaacaggtgctgctccaatcgttgcaggtgcagcaaaagaaatgggaattttgacagttggtgttgtcacaaagcctttccgttttgaagcaaagacacgtatgacaaatgcattgacaggtattgaaaaattaaaagacaatgtggatacattaattgtaatcccgaatgaccgtctgcttgaaatcgttgaccgtcgtactactatgccagaagcattaaagaaagcggatgaagtgcttcagcaggcagttcagggaatcacagatttaatcaatcttccggctctgattaaccttgactttgcagacgttcagactgttatgattgataaaggaattgcacatatcggtatcggtgaaggaaaaggtgatgataaagcaatggaagctgttcagcaggcagtatccagtccacttctcgaaacaaccatccagggtgcatctcatgttattatcaacgtatccggagatatctcccttatggatgcaaatgatgcagcaagctatgtacagaaccttacaggcgaagatacaaacattatctttggtgctctgtatgatgataaagaagcagattatgtaagaatcacagtaatcgctacaggtcttgatgatgaaacagcaagaaaaccaagcgtatcccgtgataaaaaaactgcaaaaacagaagaagtggtacagcagccggtacagcagactgcacacgtagaaactcagcagccagcttttaagatgccgactttccagcagccaactttcggaagcaatacaggtaacttcacaagtactgtgccgaagaaagatattcagattccggatttcttaaaaaatagaaagtaatacgatatacactacaaaagataaaggcggttcagattagttctggatcgccttttttagtcaaaagtttaaggagaaaaaagatggaaacaaagtttactcattttgatgaacagggaaatgcagtgatggtggatgtttcagaaaagaatccgacaagccggactgcattagcagaggggaaaattcaggtcaatcgtgaagtgatggatgcgattcttcatcatacagtaaaaaaaggggatgtgctgggtgtagcgcgtgtagccggaattatggcagtgaaacagacttcttcgttgattccgatgtgccatgtacttccaatcagtaaatgcagtgtagattttgaaattgaagaagaaaatcttacgattaaagccttatgtatggtaaaagtagaagggaaaacgggtgttgaaatggaagcactgaccggagttaatgtggctctgcttacgatttacgatatgtgtaaagcaattgataaacgaatggtgatgacggacattcatctggtagagaaaaaaggtggaaaaagcggtgacttttattttgaagaaaaataaaagccaccgatattcaaaattaaaaatttttcaagagaacatcatttttggagagactattattattttccaagtgtttctctaactaattccactggcatttcctgaccggtccagattttaaatgcttctgcaccttgatacaaaagcatggaataaccattgaaagcaatacagcctttttcttttgccattttaagcagtttggtttcccatggattatagataatatcagcaacagcaaggtcttttcttaaaagagaactgtcttctaagatgcaggtatctgtatttggagccattccgacagatgtggcatttacaaaaagtgtactttgttccagactgtgctttaaagcagttgtatcgttatgatcaaaaacagtaattttgcaggagctaagtgcggaaagtttttgaatgacttcgcggatacgtggaagataacggctggttgagcgggcgaagatatggatttctcccacattatcaagtgcagcctgagcgcagattgcagtagcggcaccgccaattcccataagggtgattgtctttcctgttacatcaatgccgtgttctttgactgagcgcataaacccaatgccgtcggtgttgtgtccgattaactttccatctttgttttctacggtgttaactgcaccaatacactttgcagcaggggaaagttcgtccagatattctaaaatttttgttttgtttggcatggttagattgaagccctttacacccattgtttttaaggctttgacggcatctccaagcgtctgttcattgatatcaaagcaaagatagacataatcaagaccgagtgcggaaaaactggtattatgcatcataggagagatgctgtgtgccaccggacttccaagaagacaggtgagttttgtatgtcctgtaattggtatcataattataaaacctcactttcattttgttacattaaagtttaaaaggaaaaaaatagagtgtcaagtagaaaagaaaattcgacaagataagagggaaagataatctttttgataaaattcgacaaaaatgtcgaaaataaatcaaattgtgataaaaattatgtaaaccggaaaataaaagaaaaaaataaagttttgcatcaaatagtttacataaagaaggtgacataaagttgcctttcgatgtcgaaaactatcggattttagcaaaaaatttttgggaagagccttgtgattttgacagaattcacacccccctagaccttataatgaacattacttagttccagataagtaattgagtcaaaaaggtctaggggggtgttttgtgtactacgaattttacatagatgtgtttttcgtagtcaatctggtaatggatttttttatcctgcagttggtgaaccggatgattttgggggctgccaacccgcttcgttcacttgcaggagctgtactgggagcagtaggaagcggtgtgattctttttttaccgttttcttcatggaaaataaggggtctgatttcctatgggattttagcaccgcttatggttatggctggatgtggaacaaaaaataagaatgtattttggatggaactgcttggcttttatggatgttctgctttggcaggaggaatttttctggcatttcccaagattgcagcaagaggaatcatcacatttttggcgttatcgtcagtcacttactggatgcttgtcatcagtatcagactcttaaaatacttaaatggaaaaaggagtactctttgccagattcaaattcgggcaggaaaaagacaaataaaagtgaaaggtctgtatgacacaggaaaccagctttgggattctttgttaaagaagccggtctgcgtgattgaatatcaggcatttaccggtcttttaagtgaaccgcagaaaaaagcgtttgatgctcttataatgcggacccaaaacgcatcggatagtctgacagaaagcctcatctgttttgaaccacactttatctgttttttaagtgtgggaacaaagagaggaagcctgcttgtcgtaactgtagatgagatgtctgtagaacgaagagaacggcgggtatccgtaaaaaaaccggttttggcacttgtaaaacaggatatgtcagtagataaaacctttcagatgattataaatccagaagtttttgacagttaggaggcgcttgtgatggaaacagcagttgtaagaagagttcaattccctgtttttacaggaatgattttgcgaagaggagaagagattcactatattggtggtgcagatgtactgccggctcctcttgatatacagacagagaccttaatgatagaaaaactgcagaccgatgagtttgaagaggcaaaagcaagtctgattgaacataatctgcgtctggtggtatacattgcaaagaaatttgataataccggagttggagcggaagatttaatttcaattggaacgattggactgattaaggcaattaatacctttaaatctgaaaaaaaaatcaagctggcaacttatgcttcaagatgcatcgaaaatgaaattttgatgtatctgagaagaaacagtaaaacgaaactggaggtttccatcgatgaaccgcttaatgtagactgggatggaaatgaattacttttgtcggatattttggggacagatgaagatgtaatttatcgtggaatcgaaagtgaagtggagcggaatctgcttggaaaggcaatcagtaaattaagtaaacgggaacagacgattatccgacttcgttttggcattaatatgccggatggaagagaaaaaactcaaaaagaggtagcggatttgcttggaatttcacagtcttatatttcaagactggaaaaacggattatgaaacgcttaaaaaaagaaatggtacgatatgagtaattagaatttaagaaatcccttctacaggaataaatcttgtagaggggattttttctttcctactttttctttctattatgcaccctgttcgatttcttttttgacttgaagaacaagtgggataatttcctgaatccgtttatctgtcattcgggtgacaggtgcagagatagaaaacgcatagcgggaacgacctttatagtcggtaagtcctacggcaatacagcgtacgccaagttcgttttcttcgttatcaagagcatagccattctttctggcttcttttacctcttttaaaaaggtgtcatagtctgtaatggtatgccgggtcagttttttgtgggtgcaggcatcccataatttatgaatctgggattcttccatgccggctgccattgcttttccaacaccggaacagtagagcggaatccggcttccgactttggaaaccatccgcacagagttttgacgtgactcttctttgtagatataaaccgcttccgagccatcgagctgtacaaaatgaactgtctctccggtttcttgagagagtgattttaaataaggtcggacaacttcaaggatatcgagtcgttctaacagacagttggataatgccagtacttttaaggacaggtcatacttctgggtttctgaatcctgctttgcataccccatataaatcaaggaggatagtagtcggtgtgtggtacttttatttaaatttaattcacggcttaaatcagccagtgaaacaggtccgatttttgacaaagtttccatagcaagaaacagccgatctgcaacctgaatagggttttttgattccataagatatcattttcctttctaactgtaacgatattatgttgaggatggtcttagatttgaggattgaggggaatttcgattcataagactttggcgctattgtaacactttccggaatgtgttacaaccagaaaattttttttgaaaggggcttgacaatatggagatctgtagtataatccaaagtaaagatatcgtattgtgaaacatagttccacattatgaaactagcggaaacgaaaaaaattatttttaaaattcaaggaggacattatgaacgcagttttagaacagctttccaaatttggcgtagtaccagtagtagtattaaatgacgtaaaggatgcagaaccgttggcaaaagcactttgccagggtggacttccatgtgcagaagtaactttccgtacggatgcagcagaggaatctattcgtatcatgacagaaaaatatccggaaatgttagttggagcaggtactgttctgacaacagagcaggttgaccgtgctgttgcagcgggcgcaaaattcatcgtaagcccaggatttgacccggaaatcgtagattactgtattgaaaaaggtatcacagtaacaccgggatgcgtaacgccttcagaagtagctcagggtgtaaaacgtggattaaaagtattaaaattcttcccggcagaacagtttggcggagttgctacaatcaaagcaatgacagcagcttatgttggaatcaaaatcatgccgacaggcggaatcaatccgaaaaatgtaagagaatacttagcttgtgacaaaatctttgcatgtggcggaagctggatggtaaaaggtgatatgattaaagcgggtgaattcgataaaatcgaagcaatgacaaaagaagcagttgaaatcgtaaaagaagtaagaggataagaatcgcagatttgcggatgagggagactttaacactgtgctagtggatggtgcagtgctaagaaataaaagatagaaattaacatgctataaatgaccccttttgccatgggtgaacatttagatagaaaaaaagggtgtggagaagtctgcatcctttttttctacaaagaaaggagcagatattatgaaaaaagattttgatttgctgtcactcggagaaattttgcttcgactttccccaccggataatgaacgaattgtgcgtggagaaacatttcagaaacaggtcgggggagcggaattaaatgtcgtatccggagctgccctgttgggccttagaaccggaatcatttccaaacttccggataattctttaggaatttatgcaaagaaccgtgtccgtttctgcggtgtcagcgatgactatctggtatatgataaagaggaagatgcaagacttggaatttatttctatgaaaatggtgcatatccaagaaaaccaagtgtcgtttatgacagaagacatgcttctttttgtaaaatcaatgaaacagaagtttcggattccatgtatgcaaatacagcctgtttccatacaagcggaattactctggcactttctgaaaatacaagagaagtagccattgatatgattaagaaatttaaggcacagggtgcactgatttcgtttgatgtaaacttcagaggaaatttatggaccggagaagaagcaaaagagtgtatcgaacgaatcctgccttatgttgatattttcttttgttcagaagatactgcccgcctgactttcttaaaagagggaaatgtaaaagagattatgaagagttttaccgaagagtatccgatttcaattgtggcatctactcagagaattgtacacagcccgaaagtgcatacctttggttcagtcatctacagtgcaaaagaagataaatactttgaagaagaaccataccgtgatattgaagttgtagaccgtatcggaagcggagatgcttatatttcaggtgttttatatggtttgctcggctgtggatttgactgtcagaaagccttggaatatggaaatgcaaccagttctgtaaagaatacgattcctggtgaccttccttcctgtgatttaaaagagattgaccgaattatccggaatcataaaaataccggaatccagcttgaaatggatcgataataaaaaataggggcatatactgatagaaaataagaatggagaaattttttatgcgtgtatgccagcttcgacaaaaagaagtgattaatatctgtacctgtaagagcctcggtgtgccgtttgaccttgagtttgatgaaaagactgggtgtgtgacagcaattattgttccgcttccggggaaaatctgtggatttttcgggccggtcagtgagtacgtgattccgttcgaatgtatcaaacaaattggggaagatattattctggtcgaaataaaagaagaaaagtttttaaaaaagagttagataaaagaaccctcggtattttgcagttacgcaccgagggatctttatcttttcacgaccgaagataatttttcatggattttaaggcatgtttttcaagccggctgacctgagcctgcgaaattccaatttcctgtgcgacttccatttgggttttcccctcataaaagcgcatttctatgatatttcgttcccttgtctcaagccggttcattgcttcttttagagagatatcctcaatccagtgttcttctttatttttcttatcactgatctggtccatgacatacaaggtgtcaccgccttcggtgtaaaccggttcatatagactgaccggactttgaatggcatcaagggcatagacgatatcctctttattgatgccgatttcactggcaatttcctgaactgttggttctcttaagttctgtttcatataatattcttttgcatggattgccttataggcggtatcacgcagggaacggctgacgcgtatggagttgttgtcccttaagtaacggcggatttcaccgataatcataggaacagcataagtagaaaagcgtacatttaatgtggtatcgaagttatcaattgctttcatcagaccgatacagccgatttgaaataaatcatccgcattttcattacttgcagagaagcgtttaattatacttaagaccagccttaaattccctttgatatataaatctcttgcttctgtgtcacccttttttatccgttcaaacagcatttctttttcggcattggtaaggacagggagttttgatgtatttacgccgcatatttcaactttattaagagccattgcaagaatcctccatttttagtttcatgtacgaatacatttataattagaatgattctcataagactgtcacaatatactgtaaaatggaaaatttcataaagttttagcccttgacaacgcataaagtgcgaaaaagattgacgatttacgcttttgtgtactatactttaggcaagcaaggcagtaaaggaggctgaaaatgatgaagtgccctttttgtaatcaggaaaatacacgtgtcatagattcaagaccggttccggataataattcgattcgcagacgcagacaatgtgatgaatgtcataaacgcttcaccacgtatgagaagatagagacgattcctcttacggtaattaaaaaagaccagagcagggaaacatatgatcggaccaaaatacaggatggaattatgcgtgcctgttataaacggccgatttcggtggaacagattgaacgcacgattgacgaaatagagacagagattttcaataaagaagaacgggaaattccaagtacggaaatcggagagattgtgatgaaccgcttaaaagaattagatgcggttacgtatgtccgttttgcctctgtctatcgggaatttaaagatgtgaatacctttatggatgaattaaagaagatgttaaagtaataagagaggactcaccgagcaccggtgagtccttatttgtctgtattattcttttttagtttctaaagtatccaaagtaacagagagaataagattaaaatgagcatcaaaacgtagtaaaaatattggatgtttgatttcttttggtggctgtcatatccaagtactccaaagacgaaaaagaggtaaagatataggagttgtttgcaaaggatgaaatcaagtttgaaaaacggataagacaaaaagacaaaaataccgagtacaataaataaaatagattttttcttcataatgaagactccgtttaaagtttttctcataggcagcctcctattaggtttaaaaaaatcagtaaaaaagaataatacagaataaataattgttaatttattatattttaacatattgactttggaaaatcaaaaaaatatttttgttaagagcacttttttcactataaagggcagttctgcttcttgcgctttgtatggtaaagtgataaaatctccataaatcaggatgcggatgaaaatgagaggagcagagacaagatgagaacatttaaaaaatcttcaaaattagaccatgtatgttatgacgtaagaggaccggttttagatgaagccaaccgtatgcaggccgatggaatcgatgttttaaaattaaacataggaaatccggcaccgtttggattttccgcaccggaagaagtcattacggatatgatttccacccttagaagtgcacagggatattccgattcccatggaatctttgctgcaagaaaggcaatcatgcagtatgcgcagacaaaaaatattccaaatgtgtcaatggaacatatttataccggaaatggtgtcagtgagctgattaatttagtgacacagggactgattgataatggagatgaaatcttagttccatctccggattatccgctctggaccggatgtgtgacccttgcaggtggaaaagcagtacattatatctgtgatgaacagtccgaatggtatccggatatcgaggatatgagaagtaaaatcacagataagacaaaggcgattgtcattatcaacccaaacaatccgaccggtgcagtttatccaaaagaagtgcttgaacagattgtggaacttgcaagagaacatgaactaatgattttctcagatgagatttatgacagactggtgatggatggaattgaacacacttccattgcttctttagcaccggatttattctgtattaccttaaatgggttgtcaaaatcccatatgattgcaggttttcgctgtggctggatgattttaagcggagcaaaggaaaaagcaaaagactatattgaaggtttaaatatgctttccaatatgcgtctgtgttccaatgttccggcacagtgcatcgttcagaccgcacttgggggacatcagagcgtgaaaaactatcttgttccaggtggaagaatctatgaacagagagaatttatttacaatgcaattaatgatattccgggcttgtcagcagtaaaaccaaaggcggccttttatatcttcccgaaaatggatacgaaaaagtttaacatcttagacgatgagaaatttgtgctggatttattaaaggagaaaaaagtactgcttacacatggaagaggatttaactgggcggagccagaccacttcaggattgtatatctgccgaatattgaacagttaaaggatgcgacaggaaagattgcagatttcctttccggatatcatcaacagatttaaacaaaaaaagggcttataggaattaaactataagccctttttttgttaggcgacaaaataaaaaatagaaataaatttcttaaaaaaccataaaatgggttgtaaaatgaaaaaaacagtgctaaattatattagtcgactaagtaaaaaggtggtgagatttcgtgaagtgcgaggaaatagatagtttacagggactgataatgcgcatgacacatttatactatggcaaagcgtatgcagcaatgaaagaattagatgttcatccaaggcagataccattgttgtttatactgcagaaaaaagaaggaatgagtcagagagaaatctgcgatgaaatgaagataaaaccgccaacggttgcggtttctatcaagcgaatggaaaaagcaggtttaattgagaaaatgccggatgaaaaagaccagagggttgtccggatttatgtaacagaaaaaggaaaatcgctgagtaagcagattgagaaagtagtcaaagaaagtgaagcaaaggtagtagaaggattttcagaagtagaaatttgtcttatgaagcggtttttgaagcaaatgatagcaaatatggaacaggaagaaagcaaaaaggagtgacacgaagattatgttaaaaatgtttcattacatgaaagaacgatggtattacgtggtaatgattattgttcttttatttgtgcaggcatattgtgacctttccctgccggattacacatccaaaattgtcaatgtgggtatccagcaaaaaggaattgaggatggagtgccggataccatccgaaaagagagtctggagcacctgcttttgtttttagatgaaaaggaaaaagcaaaagtagaagatgcctataccttaaaagatgatgtctataaaagaaatgatgtcacaaaagaggaacgagatgagttaaattcgattcttgcgattccgatgatggcagcaggaagtttagaggatgaagaaaaggcagcagaaatcaaaacacagatgggactgcccgaagagagtgatttatggcaggtattagaacaattaccgcaggaacagttagatgccatgaaagattctctgatagagaaaataaaagaaatgccggaatccattgtaacgcaggcagccgtacagtttgtacagacagagtatgaagcacagggaattgatgtagatgcgatgcagattcagtatctgatgacctctggacttaaaatgcttgcaatggcacttgtcattatgcttgcagccgtttctgttacatttttatcttcaagagtggcagcttttcttggacggaatcttagaaatggagtctatcggaaagttatttcattttccggtgaagagttaaatcatttctcaaccgcttctttgattacaagaagtaccaatgatattcagcaggttcagttagtatttgctatgatattcagaattgtactttatgccccaattcttggtgtgggtggtgtcttgaaagtcttacagaccgatgtttccatgacctggattcttggtgtggcagtcgtggcaattttaattttagttggatttctatttgcagttgcaatgccgaaatttaaaattttacagtaccgaattgatgaattaaatctggtttcaagagaaattttaaccggtctttctgttattcgtgcgttctcaagagagaaacatgaagaagaacgttttgaagaagttaatgaacgtctgacaaagacaaacctgtttgtaaatcgctgtatgacttttatgatgccggcaatgatgctgattatgaacggaattactgtattgattatctataatggttctcatgcagtagataatggaacaatgcaggtcggaaacatgatggcatttatgcagtatgcaatgcagattatcatgtcgtttttaatgattaccatgatgtcgattatgcttccgagagccagtgtatctgcaaaacgtatcaacgaaattatggagacaaaagtaagcattgaatctccggaaacagcaaaaattccggaaaataacaaaaaaggtgaagttcgttttgaacaggtaggatttgcttatcctggagcggaagaggaaacgctttcggatattaactttacagctcaaaaaggagaaaccgtagcatttatcggaagtaccggaagtggaaagagtaccttagttaacttaattccacgtttctttgatgtgacaagcggaaaaattctggtagatggagtggatatccgtgaaatgggactgcatgatttacgtgagcgaatcggctatgttccgcaaaaaggagtactgttttccggaacaattgattccaatatccgttatggaaaagaagatgcaacaaaagaagaggtcaatcgtgcagccgagattgcacaggcacaggaatttatcgggcaaaaagaaaaaggaatggaatctgaaattgcacagggtggaacgaatgtatccggtggacagaaacaaagactttctattgcaagagcaattgcaaaaaatccggaaatctatatttttgatgacagtttttcagcactggattataagaccgatgtggtgcttcgccgtgcattaaagaaagagacaaaagatgcaacgactttaattgttgcacagagaatcagtaccattttacatgcagataagattttggtattagacgaaggaaaaattgttggcgagggaactcataaagaacttttgaaaacctgtgaggtttatcagcagattgcaatgtcacagttgtcaaaggaggaattggaacatgagtaatacagcaggaagaggcagaggtccaatgggtcggagaagaggtatgtccggcgaaaaggcaaaggactttaaaggtgcaatgcttcggctcttaaaatatatggaacgttataaaatccgactgattttgatggtgatttttgcaatcggcggaaccgtatttaatattattggaccaaagattttaggtaaggcaacaacggaactgtattccggtctgatttcaaagattaacggcggaagcggaattgattttgataaaattataaaaattctcgttgttgtaatgtgtctgtatgtagtcagttcagtcttatcctttatccagggatttatcatgacaggcatttccaatgatgtgacttataatctcagaaaagatatttcaaagaaaatcaataaaattccaatgaaatattttgaaagcagaacacatggagaaatcctttcccgtattacaaacgatgtggatacgctgcagaccggaattaaccagagtgtaacccagcttattacatcaacaacaaccctgattggtgtactggttatgatgttaagcattaatgtgtggatgactttggcagcacttttgattctaccggtttcgatgtttattatcagcaaggtcatgaaacattcccagaaatacttccaggatcagcagaaatatcttggtgaagtaaatggacaggttgaagaaatttatagcggacatactgtagtaaaagcatttaacaaagaagatgacgtcatcaatgaatttgaaaagaccaatgagaaattgtacagttctgcatggcgttctcagtttttttccggaattatgatgccgattatgcagtttgtgggaaatcttggttatgttatggttgctctgcttggcggctttatggttattaaaaataaaattgaagtcggtgatgtgcaggcatttttccagtatatccgaaacttcacccagccaattcagcagattgcgcaggttacgaatatgcttcagtcttcagcagcagcatcggagcgtgtgtttgaatttttggatgtggaagaagaggaccagatggcagaaaatccagtgtctgtagaccagatagagggaaatgtcagttttgagcatatttcctttggctatgatccatcaaagattatcgtacatgattttaatgccgatgtaaaagccggacagaaagttgcaattgtaggaccgaccggagccggaaagacaacgatgattaaacttttgatgcgtttttatgatgtcaattccggggaaatctgtattgatggtcataatgtaaaagattttaaccgtatggaacttcgtgaaatgtttggtatggtactgcaggatacctggctgttccacggaacaattatggaaaatatccgttatggacgcttagatgcaacagatgaagaagtcattgcggcagcaaaagcagcccatgcccatcattttattatgtctcagccaggtggttatcagatggaattaaatgaagagaccagtaatatttcccagggtcagaaacagcttttgacaattgcaagagcgatcttagcggacaataagattatgattctggacgaagcaacttcttccgtcgataccagaacagaagagcgaattcagaaagcaatggataatctgatgaaaggacgaaccagttttgttattgctcacagactttccacgattcgtgatgccgacttaattctggttatgaaagacggagatatcattgaacaggggactcatgaatcccttcttgccaagaatggcttctatgcaaatctttataacagccagtttgaaaagatggaaacagtttaaagtgtaaaactttaaattactaaaatattttttgcaaaatgggttgacaaacgataaaaaagtcagtattatttggttagattaattaagagaggttttaccatgatgaagaatttattgaatgtatggacaaaagatttttattttggttatctgggttatttttataatgcaggtcttttgtgctatggtaaagcatccgtcaatcaattctgatttcaaagataccgataacagaattttaaccggtgtttgccttagcaggtgaacatcggtttttggttttatgagataaaatcttataaaaaaattcattcaatccaaaggagaaaaagtcatgattattgttttaaagaaagatgcagaagaagcgaaagtggaaaaattaaaagagaatttggtgaacagaggattaaaacttcatttatcacagggcgaagataccacaattattggtctggttggagacactacagagattgaaccggagcagttacaggcatttgacgtagtagaaaccgtaaagagaatcaaagaaccttacaaaaaagcaaaccgcagtatgcatccacaggacagtgtgattgatatctgtggaaagaaattcggtggaaatcattttcaggtgattgcaggtccgtgttccgttgagaccagagaacagatggttgaagtggcagaagatgtaaaggcatccggtgcaggtcttttaagaggtggtgcattcaaaccgagaacttccccatactctttccagggactgggcagtgaaggattaaaactgcttttagaagcaaaaaaagcaaccggacttccaattgtgacagagattatgagtgcagcacatctggatttattcgatgatgtagatgtgattcaggttggtgcaagaaatatgcagaactttgaactgttaaaagaacttggaaagataaataaaccgattttgttaaagcgtggcatgtcaagcaccatagatgaacttttaatgagtgcagagtacatcatggcaggtggaaacgaacaggttattttatgtgaaagaggaatccgtacctttgagacttccatgagaaacacactggacatttcagcagttccgatgttaaaatcaaagacacatcttccggtgattgtagacccaagtcatgcagcaggaatccgttttatggtagagccgcttaccatggcagcaatcgcagcaggtgcagatggtgttatgattgaagttcacaataatccggaaaaagcattatgtgatggtatgcagtcactgacaccacaggcatttgatgatgtgatgaaaaaagtgaagaaaaccacagagttttttggaaaggtaatgtaataacatgaagtcattagtactggcggagaaaccatcggttgcaagagatattgcaagagtattaggctgcagtaaaaaactaaatggggcaatcgaaggaaaccgctatgttgtcacctgggcgttaggacatcttgtgacacttgcagacccagaggaatacgacaagaaatataaagaatggaagctggaagaccttccgatgatgccgaaaaagatggaacttgtagtaattaaacagacggcaaagcagtatcatgcagtaaaaacacagctttatcgaaaagatgtgaatgaaattattattgcaacggacgcaggcagagagggagaattagtagcacgctggatattggaaaaatccggatgtagaaaaccaatcaaacggctttggatttcctctgttacagacaaggcaatcaaggcaggattttcttctttgaaagacggcagggagtatgatacattatattcagcagcctgggcaagagcagaggcagactggttggttggaatcaatgcaaccagagcactgacctgtaagtacaatgcccaattgtcctgtggaagagttcagacaccgacacttgcaatgattgaaaaaagagaagaagaaatccgttcctttaagccggagacgtattatggaatcaatctcatggcagagggaatccggtttacctggcaggataaaaaaagtggttctgcccgctcattttcaaaagagagaatcgaaacactcaaacaaaaaatgcaaggcgctccccttttcataaaagaagtagagaagaaagcaaaaaaaacttatgcaccggcactttatgatttgactgaactgcaaagagatgcgaataaaaaatttggattttctgcaaaagagacgttaaatatcatgcagaggctctatgaaaatcataagatactgacctatccaagaacagattccagatatttaagttccgatgtcattggaacattaaaggaacgcttaaaagcatgtgcagtcggtccatataaaaagatggcaggaagtctttcaatgaagccggtcaaggcaaataaatcttttgtggatgataaaaaagtaagcgaccatcatgcaattattccaaccgaacagtttgtacagttagaacatctgacaaatgaagaacgaaaaatttatgatctggttgtcagaagatttctggcagttttgtatccgccgtttgaatacgaacagacaacagtaaaagcaggctgtgaggaagaagaatttcttgcgaaaggaaagattgtcttaaaagaaggctggaaggaggcttatgagggaagctggtcagatgaagaggatgaggaacaaaaaggagagtctgctttaagagaacagaaacttccgaatctggaaaaaggcatgcagttttcgaataatattcgaattgaaattataacagggacgacacgtccaccggcacattttaatgaagcgacactgctttcagcgatggaaaatccggtgcgctacatggaaagccgggatgcaaagacagttaagactttaggagaaaccggaggacttggaacggtagcaaccagagcagatattattgataaactgtttcattcctttttgatggaaaagcgtggaaaagaaatttttattacctcaaagggacgacagcttttaaaattggttccggaagatttgaaaaaaccggaactgacggctgactgggagaataaactttctaagattgcagagggaaaattaaaggataaaatctttctttcagaaatccgcatttatgcacaggaattgaccaaagagattaaaacgggagatggaaccttccgccatgataatcttacaaacacaaaatgtccggtatgtggaaagcgtatgcttgcagtcaatggaaaaaacagtaaacttttggtatgtcaggacagagaatgtggacatagagaaacaatttcccgtacgtcgaatgcaagatgtccaaaatgtcataaaaagatggaattatatgtaaaaggcaaagaagatacctttatctgcagttgtggttataaagaaaaactgtcttcttttacagcaaggcggcagaaagaaggcgcgggagtcagtaaaaaagatgtccagcgttatctgaacaaacagaaaaaagaggcagaagaaccaattaattctgcatttgccgatgcttttgcaaaattaaaattgtaaatataaaaaaaagtttagaaactgttcataaaaatatttcttgtgaatcccccttttcttatggtaaaatgtcactatgctaaagtgaaaaaataagaaaagggggattctgctatgggattcaatatgaaagtaacaccggaaatcgaggctcttacaaaagtttgcgaagaaaacagtaaaatggatgtatctctttatggaaaatatgatgtaaagagaggtctgcgtgatatcaatgggaaaggtgttcttgcaggtctgacacaggtttcaaacatcgtttcgagtaaaactatagatggaaaaagtgttccttgtgatggggagttatactacagaggaattaatataaaagaccttaccaatggttttttaaaagaaaatcgttttggatttgaagagacaacctatttattgttatttggtgtacttccaacagaagagcagttaaaagatttctgcaaaatacttggaaatcagagaagtctgccgagaaatttcgtacgagatgtcatcatgaaagctccaagtaaagatatgatgaataccttgtcaagaagtgtgctgacgttatattcctatgattcgaatccggaagatatttctcttccgaacgtgctgcgtcagtgtatcaatcttatcagtattttcccaatgttatccgtttatggctatcaggcacatagacattataatcaaaataaaagtttatatattcataatccgaagaaagaattatcaactgctgaaaatattttgcgtatgttacggtcggataaaaaatatactccgcttgaggcaaagattctggatttggcactggtacttcacatggagcatggaggtggtaacaactctacgtttacaactcatgttgtttcttcctctggtacagatacctattcagccattgcagcagcacttggttctttaaaaggaccgaaacatggcggtgcaaacattaaagtagtcagcatgtttgacgatatgaagaagcatgttcacgattggaaagatgaagaggaagtttctgcttatcttcgaaaactgcttcataaagaagcatttgataagcgtggtctgatttatggaatgggacatgcggtttattcgatttctgatccgcgtgcacggattttcaagcagtttgtgaaacagttagccgatgaaaaaggaagacagaaagattatcgtctgtatgaaatggtagagcgtcttgcaccggtgattattgctgaagaacgtcatatttataaaggtgtcagtgcaaatgtcgatttttacagtggatttgtttacagcatgttggaacttccccttgaactgtatacaccaatgtttgcgattgcgcgtattgtcggctggagtgcgcaccgaatggaagaactgattaacacggataagattattcgtccggcatataaaaatgtattagaagaacaggcttatattgctttggaagaaagataattgacaaaaaacgagatttccgttaacatcgggtatgaatacacaacagaaatgaggaaaataaaatgtttcgtaccttttttccggatgaatatctggactctacttatgagattgattttgaaaaattgtatcaggacggttaccgtggattgatttttgatattgataatacgttagttcgtcatggggaaccggcagatgaacgtgcagttgcattatttaagcgcttaaagaaaatcggatttgactgttgtctgctttccaataatcagtatgagagggtttcttcttttaataaagaggtgcaggtgcattttattgaagatgcacataagccatcgaccaagaattatatcaaggcaatggagctgatgaaaacagaccgttccaatacgatttttgttggagaccagttgttcacagatgtatatggggcaaaaagaaccggaattcgcaacattttggtaaaaccaattcatccaaaagaagagattcagattgtgtttaaacgcaaattagagaaaattgtgctttatttctacgagaaagagaaaagaaagcaaaaaaatggttgaaaaattaagtcgggtattatacaatgaagtacagtggaaaaaacgattttattttccaatggaagaaggccacgaaaatcaagtggtaaacaaataaaatctaggaaaggaaaagctatttagatgaaaacctatatctaatcaactaaaaatgaagttataggtgtgtaccgatggctagtcgggaatttacgactgtggagtgtacaagaatttacgagtagatagatattttttatatcatcaaaagtatacacgatgaagcagtaactacaaatcgtgagattgtagcgaatcatctagcatatacgcatttgtatatgtttttagtagcaggagtattcattatgatatcagcaggcgattttaaaaacggtcttactctggaaattgacggaaacgtagtacagattatggaattccagcatgtaaaaccaggtaaaggtgcagctttcgtaagaacaaaattaaaaaacgtaatcaacggtggtgtggtagaaaaaactttcagaccaactgaaaaattcccacaggctcgtattgaccgtgtagacatgcagtatttatacaatgatggtgatttatactacttcatgaacaatgaaacttatgaccagattgcaatcgacaacgaaacagttggagattctctgaaatttgtaaaagaaaacgaagttgtaaaagtatgttcctacaatggaagcgtatttgcaatcgaagctccgttattcgtagaattagagattacagaaacagaaccgggattcaaaggtgatacagcacagggcgctacaaaacctgcaatcgtagaaacaggcgctactgtttatgtacctctgttcgtagatcagggagacagaatcaaaatcgatacaagaactggagagtatttatccagagtataatgattgaaagcactcagccggaagattacttccggctgtttttttctttaaagagagagttcctgtttttttaagtcatagtaatagacatgattggaaagcacttcttcttttgcaacctgtgtggaattgacttcgacaaccatttcctctaactccggtttggaataaactccaaagtcaggaacgagaatacattcatgtacgctgcttggcagaacaaagaaattacagccaagaagtgctgaaatatgagaaagtacgtgaggatagagaagagcagctgcgccaaaatacgtttcctgattggttaaaatatacatggagtttggggaaaattcggagggaagaagtgattcatcattagagagctcgcgaatcagagcatccatttctttaaaacaaaaaggaagcttgcggcaggtattgagtctggcgtcacgaattaaatcatctgtggaaacattccatgcggtaaggttggaattgtggattagaaagcttccgttttgaagatttggggcggtaactttacagtaaaagacaattgccaaatcgagataagggatatggggaattttgtttaagagagaacggttcatttcgtaattgatgagtttatagcagacatgcgtgcgcattttttgataatcatgaacttcatcagtcagtgcaaacgaagcctccggctgatgctgttggttgagttcaagaatccgcctggcaatgcgctcaatggaaatgccttgacaaaaccagggataaaaatcgtctaaataaaaagtaggagcaatttgacctccttttttcataatgataacagcatctgcacagcttccgttatttttgtcaatacagtgtaaagaaaccgactgctcgggatctgccaaatcctgaattgcaagtaacagttcttctttaaagagattgtagtccatagtatgacctcctgagattaaaatataaaattataatgtgaaataaaatataggaattttttcggagaagttccgaaaagaaattagaaatgtatttcaataatataccatgagtgataggaaactgcaagcggtcatttattaaaaaagtctaaaatcgaaaatcaggagggtttacaaccaatccgttttatgataagatattttacgtcagtaagcactcgtagctcaggggatagagcagtggtttccggtaccacgtgtcgggggttcgaatccctccgggtgtgttttttcttttttttagagaaaaaagcagagaataagggtaagagataaaggaggatgctatgttagacaacttcagagaatggctgtcagataatctgagatatattcttctgggtttggctattttagttgttctgctcgtcttattttttggagtccgtgcagtgacaggacttgttacttcaaaggagaaaggaaacacaacggaaaagacacaggttgtagattctaagaatgataacacagaagcaaaagatgagagcaagaacaatgacaaaaaagaagaaacctcttctttagaaaaaaatgcgtaccctgaagtaaattcattaatcaattcgttttatgaggcatggggtcgaaaagacatagagcagatgaaacagctcacagataatttagatgcagccgatgaagcgaaggttacaaattcgacttatattgaaagttataatgatattactgtttatacgaagccgggtttaacggatgatagttatgttgtgtatgcttcttataaattaaaatttacagatattaaggcagaagcaccagggctttcccagctatatgtcatgaaaaatgaagacggttcttatattatccataatgacagcagtgatgaaaaaattaatgcctatcttcagaaagtaacacaagatgaagatgtacagaaactggtttcacaggtggaggatgatttgaattcggcaattgaatcggatgaagatttaaaagcatttgaagaacagcttggtcaggacagtaattcttcagcaagagcagaagaaggtgcaacacttacggtacaggaagactgcaatttccgtgcggaagcggataccgaagcagaaattcttgatgtgattccgggaggaacagaggtaacaaaggttgcagatggtccggaaggatggatagaagtagaatataataatgagaaaggttttgtttcgcaggatcttttaagataacaaaaaacccagcttataaaagctgggattttttgttattattcaggacttataattatcggagtgcaccataggcaccgccattttccagattgattccttttgcggcagccagttcactgactgttaccatctggaatccttttgcttttaaggcagggacaatcatatcaacggcgtctgctgtcggaccatgaatatcatgcattaagataacatccccatcctgtgcagtcattgccgcttcgtaggtactctgggcatttttggtcttccagtcgagtgtatcaatagaccataaaatcataggaaatccgattacggattttactgtagaattataagaaccataaggaggacggactaaagaagcaccgtgtccgacaagcgcatttaatttgtcgtttgtagaacttacctcgttttgaatcgctgtcgtatcaagggttgccaaatccttatggtcaaaggtatggtttgcaagttcacagcctagactttccatttttttaacagcgtccggatagtttgggatatttgttccaagcatgaagaaggtcgcttttgcaccgtttgctgccagtgtatttaaaatacgttcggtatactgaccaggaccatcatcaaaggtgagtgcaaccattggaccggagcccgttgtcttaacagcagtggatttgccatcccatactccattttcgtcaaaggtatattttttgttgtcaataatcagttcaccggtagccattgtgccatcctctttcagataataccatttggagtcaagttgtaaccatccggtttttggaagtccgttttcatccagatagtaccagctgttatcgtacttataccagtcggaagttaccagtgtaccatcagaatttaagaagtaagtctggttattaacggttatctttccggtcataatagttccatcttctccaagatagtaggtttttccgtctttttcttcccaggaattggttatcatgtagccatctccgtcaaggcagtaggtttttccgttatctgtaatccaaccaatcatcatcactccgtcctcacggaaataataccatttgtcgttgatactgcgccatccggttgaaatcgcaccggaagtatttaaatagtaccagtttccgtcttgctgaatccagcagttagaagccatggaaccatcatcattcatataatagctggtgccgtctgcttctacccatccggtagccataatgccctggtcatttaaacagtaccatttgccattgtcacttagccagccggttttaggtgttccgtcgctgtttaaataataccatttgccgtcgtctttaacccatccggaagcaggtgttccgtttgctgtcagatagtaagtagagcctttatccgtaatccatccggattttacatatccgttttcgtcaaagcagtaacggactccgtcaatctcacgccaggtatttttaattaataccccatcatgatagacatacttacgaccattctcatcgtatacccagtggtcctccagcagagcttctttcttatcctgataagtatcgagggctgtttttacagctgcgaaaatatatttcggtgcaaaaatcaaaatcactccgacaatacaggtaagcaggatgatacccacagttttctttgagtttttcataatgtgtttttacccctttgtaattcaggcattcttcttttagcaacgcaggcacagctctacaattgcccgcagattttgttttgaaaaagtgtttttcaaataaaaaaagaagaatacgtttctatgtacctgtctattatacgcttgcactcttggatttggcaagtaagatttcaagaggagttctttttgggcttttctttgctttgcgggagaagatatggtatactttttctattgcgataaggatggatacgcaagaatagaaaaaggagtaaagatgcgtttaaacaaatatttaagtgatgcaggagtctgttccagacgagaggcagaccgtctggtggaggcaggaagaatcacaataaacggcgaaactgcccggatgggaatgcaggtgtcagatgaaacggaaatctgcattgatggaaagaaaatcatccgtgaagaaaagaaagtattattagcatttcataaaccgcgtggaattgaatgtacagcaaatccaaatgtaaaaaagaatgtgatttcttatattaattatccaattcggatatattatataggaaggttggataaagactcagaagggctgcttttgctgacgaatcagggagaactcgtcaataaaatgatgcgttccggcaatcagcatgaaaaagaatatgttgtgacagtaaataagccggttacgaaagaatttatcaaaaaaatgcaggatggtgttccgattttaggaaccaaaaccagaaagtgccgtgtcattcaaacaggagaaaaaagttttcgtattatcttaacgcagggtttaaaccgacagatacgaagaatgtgtcagtatctcggatatgaagtaaaacgcttaaagcggattcgggtaatgaatattgaactgggtgatttaccggttggatcgtatcgggaagtgacggcacaggaaatgaaaacattgcaggaaatgattaaagactcttcggaaacaaccgtaatcaaaaaagaaagggggaagaaatgtgaaccggacagaaagaatgaaggaactcgtcgaattgttaaataaggcaggaagagcttattatcaagaggatagagaaattataagcaattatgagtatgataagctttatgacgagttagaagcactggaagaagaaaccggaattacgcttgcgggaagcccgacggtttcagttggctatgaagcagtcaatgcgcttcccaaagaaacgcatgagacaccgatgctttctttggataagacaaaagagatagaagtgctgaaaaactttgtgggaaatcaaaaaacagtgctttcctggaagatggatggtctgacgattgtactgacgtatcaggacggaaaattaaaaaaagcggtcactcgtggaaatggaatagtgggagaagttatcaccaacaatgcaaaagtgtttaagaatgtgccgcttcagattgcctatcaaggagaactgatattgagaggggaagcaattatctcttattctgattttgaaaaaatcaataaacagattgaagatgtagatgcaaagtataaaaatccaagaaatctgtgcagtggttccgtgcgtcagttaaataatgagattacagcaaaacgaaatgtatacttttatgcgttttctctggttcgtgcagaaggagtgaattttaacaattcaagagcgtgtcagtttgaatggctcaaaacgcaggggtttgatattgtggaatatcgtatggtggacagcaaaaatctggaagaaacaatacagtatttttcagataaaatttccacaaatgattttccgtccgatggattggtggcattatacgatgatattgcctatggagattctctcggaagtaccgcaaagtttccaagaaatgcttttgcttttaaatggaaagatgaaatccgtgagacaacgttaaaggaaattgagtggagcccatcaagaaccggactgattaatccggtggccatttttgagccggttgaactggagggaacaacggtaagccgtgcaagtgtgcataatatcagtattttaaaagaactggaacttggaattggagaccgtattgaagtctataaggcaaatatgattattccgcagattgcagagaatcttacaagaagcagaaatttaaccattcctgactcctgtccggtctgcaaagagccgacaaagatacaaaaaagtaatgacgtggaggtactaatctgtacaaatccggagtgtcaggcaaaaaaaatcaagtcctttacgttatttgtgagtcgggatgcaatgaatattgacgggttatcagaggcaacacttgaaaaatttatcttaaatggatttatcaaagaatttggtgacatttatgaattggaacattataaagatgcgattatagagatggatggatttggtgaaaaatcgtatgaaaatctgattgagaacatcaaaaaatcttctcatacaacgcttccaaggctggtctatgcgcttgggattgcaaatattggagttgcaaatgcaaaggtgctttgcaagaaatttgattatgacctgcaaaaactgatgcaggcggatgaagaaactatcagtcagatagagggaattggttcagtcattgcaaaaagcgtgacggattattttaaaaatgaaaaaaatcagagaaagttagaacacttgctgacttatttgacgtttgaagaaatgaaaatagaaacgggaaatccgctgtcgggaaaacagtttgtcataacaggaagcgtgaaccaatttgaaaaccgaagtgcaatgaaagaatttattgaaaataggggcggaaaggtaaccggaagtgtcagcaagaaaacggattatctgattaacaatgacacagaatcctcttcatctaaaaataaaaaggcgaaagagctgggaatcccgattctttcggaagaagattttttaaaacttgcagaatcggtacaatagagaaagaaggcagacttgatttatgaaaaaagaatggcagataaaaggaattagagggattaaaacgattatttttggtcgtaccctgattgtggctgttgcatttatcattcagtttttgcttcttggtgtcacttttttctgggcgaaagagtatagcgggattgtatatgccggcttcagcgttttaggtttaattgccctgctccatatttttaacagtcggggcaatccggattttaagctggtgtggatgcttccgcttttactttttccggtttttggagcactgttttatacctatattatgatacagcctggaacaaaaatgatttatcaaaggcttcgtgtactgggtgaaaaatcaaaagtctatttaaaacaggacgagaaaacatttgaaacgttaaaagaagaaaatccacagatggggcggatggcagattatctcctggaacatgggaattgtccggtttatcaaaatacgacgattcaatattttccactaggagatgaccagtttccggaattgttaaaacagcttaagaaagcagaaaaatttattttcctggaatattttattttagaagaaggatatatgtgggagtctgtgcttgaaattttacaggaaaaagtgaaggccggagtagaagtacgtgttatgtatgatggaatgtgtgaactgacattacttccaaatttttatccaaaattactgaaaaaatatggaatccagtgcaaaatgtttgcaccaattcgtccggtcttttccagtcattataataaccgcgaccacagaaaaattgttgtgattgatggaaaagtggcttttacgggaggaacaaatctcgcagacgaatacattaataaaaaagaacgatttggtcactggaaagataccgcagtaatgataaccggagatgccgtacagaaatttacctgtatgtttttggaaatgtggcatacaacagaaaaaaaagaaccggattatgaatcgtatctgacaccaaaatcaatattaaaggaaaaagatggttacgtgattccttatgatgtcatgccttatggaacagaacgtgtcggaaaacagatttatctggatattttaaatactgcctgccagtatgtacatattatgacaccgtatctgattttagattatgaaatgattagtgcactgacctatgcggcaaagcgtggagtagaagtttcaattattatgccgcatattccggataagcaatatgcatttgcacttgctaagacgtattataatgaactattagaggcaggtgtgaaaatttcggaatataaaccaggatttgtgcatgcaaagatatttgtttctgataacaagaaagcagtcgtaggaactgtgaatctggattatcgaagtttttatcatcattttgaatgtggtgtctttttctacgagaattctgaaatccaaaaaattgaagaagactttgaagagacaatgaaaaagtgtatccatatatcattagctgattataaaaaactaaaacttgcaacaaggatagagggaaaagtccttcgtctgattgcccctcttatgtaaaacagaaaggataaaaaaacaatgccaattaaaatacaaagtgatttacctgtaaaagagattctggagaaagagaatattttcgtgatggatgaaaagcgtgcctcacatcaggatatccgtccgattcaaattttaattttaaatctgatgccgttaaaagaagatacggaacttcagctgcttcgttccttgtcaaatactccgcttcaggtggatgtctcttttatgatggtggcaacccatgaggcaaaaaatacagcgaccagccatttgaataagttttatgaaacattttctgaagtaaaacacagaaaatttgatggaatgattattaccggtgcaccggtggaacagatggagtttgaagaggtagattattgggaagaattaacacagattatggattggacaaaaaccaatgtcacatctacaatctatctgtgctggggagcacaggcaggattatattaccattatggtctgaaaaagagactgatggataaaaaagtctttggattgtttagacatcgtgtagagaatcgaaagattccgctggttcggggatttgatgacgagttttgggcaccacattcccgtcacacagaggttccggcagcagagattcatgcctgtgaagcattaactgtacttgcagaatcggacgaagcaggagtatttttatgcatggcagaagatggacgtcagattttcgtgatgggacatccggaatatgaccgtgttactctggacggagaatataaaagagataagagtaaagggctggatattgagattccgaagaactattatccggaggataatccggaaaacagaccattgcttttatggcgttctcatgcaaacaatttatacacaaactggttgaattattacgtataccagacgactccgtattcttttattaatactgctgaaattattggaaaataatagaagaaaaaaagaacgatttctatattgacgtcagaatgaactttggatataataaacagcggaatttaagcggtacagcgttgccaaacaaaagcgtagaagcgtaagcctgtaaaaaatgatgggtcgaaattgcgaaaggagaaaaaaaggtttgggaaaagaaaaaaaacaagtagagtacacgagtgagtatgaactggaaggacgaattccactggggagagccatacttcttggtatgcagcatgtgcttgcaatgtttgtcggaaatctgacgccgattctgattatcggaggaatgtgtggactggcagatgcgggactgatgcgtccggttttgcaaaatgcaatgttaattgctggtattgttacgttaatccagctttggacgataggaccggttggctcaagattaccgattgtaatgggaacaagttcagggtttatcggtgtttcaaaaggaattgttgcttcatgcggcggaggtgttttagcttatggagcgattatgggagcctgtttgattggcggtctgatggaaggtgttctgggattcttcttaaaaccattaagaaagtttttcccggcattggtaaccggtacagttgtaacagcgattgggctttctcttatcagtgttggaattaattcctttggtggaggaaattcaaatggagactttggctctattccgaacttatttgttggtactttggttttggtttctgttattttatttaagcactttacaaaaggaatgacaagttctgcatctattctaatgggaattatcgtaggttatattgcctgtgtgattatggcattggtgcttccaactacatataccgatgcagagggggttgtgcagacctgttcctgggtgattgactggtctaaagtggcagatgcatcctggtttgaaattccgaaatttatgccggttaaaatgacgtttgatttaagagcgattattccgtatttaatcatgtttattgtaactgcagttgaaacaatcggagatatttcaggtgtcgcagaaggcggattagaccgtgaggcaacggataaagaattatccggtggtgttgtatgtgatggttttggttcttcatttggttctttatttggtgtacttccaaatacctcatttagccagaatgttggtcttgtaggtatgacaaagattgtcaatctgtttgcaatctcaatgggagccatctttttgattatctgcggtcttgtgccaaaggttgcagctttagtggaaattatgccacagtctgtacttggcggagcggcagttatgatgttttcctctattgtagtaagtggtattaaactgcttacaaaagatggagttgattcccgtgcagtaactattatgtcagttgcacttggatttggctatggacttggttcaacagcagatgtattaaatcagcttccatcctgggtcagctatgtatttggcggttccggtattgttccggcagcggttgttgcaatcgtattaaatattttaattccggtaggaacagatccatttgaaaagaaagaagaaaaagcggaataaaaaaataaaaataaaaatgctcagagccgttatgactctgagcatttttatttttatttagttgtcttcttcggtcattgtatagacagattgacgtttctttgccatttcatcactttcaagatattcatcataagttgtaatcttgtcgataagaattccgtttggcataatctccatgatacggtttgcagttgtctgtacaatctggtggtcatgggatgcaaataagataacaccaggaaatttaatcataccattatttaaggcagtaatggattccatgtccagatggttggtcggctcatcaaagagcagtacgtttgcaccggaaatcatcatcttagataagagacatcttactttttcaccaccggaaagaatacgtacttttttcacaccatcttcaccagggaagagcatacgtccaaggaaaccacgaacataagttgcgtctttgatttcagaatactgggtcagccagtctgcgatggttaagtcattgtcaaactcaagtgtgttgtctttcgggaagtaagactgggaagtagtaacgccccatttataagtaccttcatccggctccatttctcccatcagaattttaaagagaacagtttttgcctgttcgtttccaccgacaaaagcaactttgtcttcgcgtccgagggtaaaagtcagattatcgaggacttttactccatcgactgtcttggaaagaccttctaccattaatacttcgtttccgatttcacggtttgggcggaaatcaatgtaagggtatttacggctggatggacgcatttcatcaagctgaattttttcgagcgcacgttttctggaagtcgcctgtttggattttgacgcatttgcagagaaacgggaaataaattcctgaagttctttgatcttttcttctttcttacggtttgcttctttcatctgtttaattaagagctggctggattcataccagaaatcatagttacctgcgtataactggatttttccgtaatcaatatcagcggtatgagtacatactttatttaaaaaataacggtcatgggatacaacaataaccgtattttcaaagttgattaagaattcttcgagccattcgattgcgtttaagtctaagtggttggtcggctcgtcgagaagcagaatatcaggatttccaaataatgcctgtgcaagcagaactttgactttctggcttcctgttaaatctcccataatagcgtaatgaatttcagtctcgattccaagtccatttaataactgggcagcatcggattctgcttcccatccgttcatttctgcaaactcaccttcaagttcgctggcacggataccatcttcatcagaaaaatcttcttttgcgtagatggcttctttttctttcatgatttcataaagacgcttgttacccataattacagtatccagtaccggataagcgtcgtatttaaaatggtcctgctgaaggaaagagagacgctgaccaggagtgattgtgatatcaccacttgtagtttcgagctgaccggagaggattttcaggaatgtagattttcctgctccattggcaccaatcagaccatagcagtttccctcggtaaatttaatattaacatcttcaaacagtgctttttttccaattctcaaagtaacattatttgctgcaatcatgtttttacctcacttatttctatatacaaactgtgtgtgcataatctcttcctattttacagtaaaatagggaatttgcaagcatttctttcaaaatacttgataaattaagtatacataggtataatgatggcacttagagcatgtcgaatgatgacaggaactaaatgagtaaaaattttttatagataaaatgtactctcggagttcttattgtatttgcttttgtggctgatttttcgtcggatgcacccgaattttatcaacatatgcgccgcatatctgacaaaaaatcttctcacgaaatcaagtacagaaatcaagcacagaaaggttctgaaagtacgttaaagaagaagggagaagctatgctgattaccagagaatgtgattatgcagtacgtattgtcagagcactggcaggaggtcagaaaatctgtgtgacacagatttgtgaagaagaagtgttgacacctgcttttgtatataagattttaaaaaagatggaaaaagccgaacttgtgaaaagttatcgtggcagtaatggaggttatgccttaaataaaggaattgatgaaattactttaatggatatttaccgtgcagttgagccggaatttttcatgattgaatgtatgaatccagataagccgtgtgttcgaaatcagggagatggctgcaaagtacataaagaattatgcagaattcagaaagtactgacaagagagttaagtgctaagacaattaaggaaattatagaagcataaaaatgtttttttgagaaaacattgcattttcttttcttataaaaatagacataatttgtaaatcgtgatataattattgacagacttcggagagcgaagtgaacattgtttaaagttgtaacaatttacaaggaggaaaaaacaaatggctagaaagatgaaaaccatggatggtaaccatgcagcagctcatgcttcttatgcattttctgacgttgcagcaatttacccaatcaccccatcatccgttatggcagaagctacagacgaatgggcaacacagggaagaaaaaatatttttggacaggaagttcaggttacagaaatgcagtctgaagcaggtgcagcaggtgctgtacacggttcccttgcagcaggtgccctgactacaacatatacagcatcacagggtcttctgttgatgattccaaacctttacaaaatcgctggtgagcagttaccgggtgtattcaacgtatcagctcgtgctcttgcaagccacgcactttctattttcggtgatcattccgacgtatacgcatgtcgtcagacaggatgcgctatgctttgtgaatcttctgtacaggaagttatggacttaacaccagttgcacatttagcagcaatcaaaggtaaagttccattcatcaacttcttcgacggattccgtacatctcatgaaattcagaaaattgaaacatgggattatgaagatttaaaagatatggcagatatggatgcaatcgatgagttccgtagaaatgctctgaatccaaatcacccatgtcagagaggttcagctcagaacccggatatcttcttccaggcaagagaagcatgtaacccatactacgatgctcttccggcaatcgtacaggaatacatgaacaaagtaaatgaaaaacttggcacagattacaaactgttcaactactatggtgcagctgacgcagaacacgtaatcatcgctatgggttctgttaatgatacaatcgaagaaacaatcgattacttaacagcagctggacagaaagtcggtgttgttaaagttcgtctgtacagaccattcagcgcagcagctttagttgaagctattccggaaactgtaaaacagatttctgtattagatagaacaaaagaaccaggtgcacttggcgagcctctgtatctggacgtagttgcagcattaaaaggaacaaaattcgatgcagttccgattttcacaggtcgttacggtttaggttctaaagatactacaccggcacagattgttgctgtatacaataacacagaaaagaaaaaattcacaatcggtatcgttgatgatgttacacatctttctctggaaacaggtgctgcacttgttacaactccggaaggaacaatcaactgtaagttctggggtctgggtgcagatggtactgtaggtgctaacaagaactccatcaagattatcggtgataatacagatatgtacgctcaggcttactttgattatgactcaaagaaatccggcggtgttacaatgtctcaccttcgttttggtaaaaaaccaatcaaatctacttacctgattcaccaggcaaactttgttgcttgtcataatccttcttatgtaagaaaatacaacatggttcaggaattagtagatggtggtacattcctgttaaactgcccatgggatatggaaggacttgaaaaacatcttccaggacaggtaaaagcgtttatcgcaaaccacaacatcaaattctatgtaattgatggtgttaaaatcggtattgaaacaggtatgggtcctacacgtatcaatacaattcttcagtctgcattcttcaaactggctgcaatcattccggaagaacaggctattgatttaatgaaagctgctgcaaaagctacttacggacgtaagggtgatgatgtagttgctaagaactgggctgctatcgatgaaggtgcaaaacagatcgttgaagttactgttccggaaagctggaaaacagcagcagacgaaggtcttgacacaacacatgcagaacagggaagaaaagaagttatcgacttcgttaacaatattcagtctaaagttactgctcaggaaggtaatacactgccagtatctgcattcaaagattatgtagatggtacaacaccatccggaacatccgcttacgaaaaacgtggtatcgcagttaacgttcctgtatggaatccggaaaactgtatccagtgtaaccgttgttcttatgtctgcccgcacgcagttatccgtccggtagctctgacagaagaagaagcagcaaatgctcctcagacacttgaaatgactggattaaaacagtacaaatttgctatcgcagtatccgctcttgactgtacaggatgtggttcttgtgtaaatgtctgcccaggtaaaaaaggtgcaaaagcacttgctatggaaaacatggaagcaaatatcgaaatgcagaaattctttgattactctgtaactcttccggaaaaagaagacgttatcgctaaattcaaagaaaacactgtaaaaggttctcagttcaaacagccattacttgagttctcaggtgcttgtgctggttgtggtgaaacaccttacgcaaaactgatcacacagttattcggtgacagaatgtacatcgcaaacgcaacaggatgctcctctatctggggtaactcttcaccgtctacaccatacactgtaaacgcaaaaggacagggtcctgcatgggataactctctgttcgaagataacgcagagtttggttacggtatgttactggctcagaaagcaatccgtgaaggattaaaagcaaaagttgaagctgtagcagcaaacgaaaaagcttctgaagaagtaaaagcagcttgccaggaatggttagatacttatactgtaggagctacaaacggtgcagcaacagataaactggttgcagcattagaaggcattgactgtgatgtatgcaaagacatcgttaaaaataaagacttccttgctaagaaatcccagtggatcttcggtggtgacggatgggcttacgatatcggattcggtggtgttgaccacgtattagcaagtggaaaagacatcaacattatggtattcgatacagaagtttactctaatacaggtggacagtcttctaaatctactccgacaggtgcaatcgcacagttcgctgccggtggtaaagaagtgaagaagaaagatatggcatctatcgcaatgagctatggttatgtatacgttgctcagatttctatgggtgctgacttcaaccagactgtaaaagcaattgcagaagcagaagcatatccgggaccatctctgattattgcttatgctccatgtatcaaccatggtatcaagaaaggtatgtctaaagctcagacagaagaagaattagctgttaaatgtggatactggcataacttccgcttcaatccggaagcagaaagcaagttcacacttgactctaaagctccaacagaagactaccaggcattccttgatggagaagttcgttacaattctctgaaacgttctaatccggaaaaagctgcaagactgtttgcattaaatgaagaacaggctaaagctagatacgaatatctgaacaaactggttactctgtacggaaaaacagaagagtaattcataagttagaatgatagctcaataaaattggcgggcgtcaccttcgggtgacgtccgtttttggttttatattttcaagatatgtggtaaaataaacacaatggagaaagaatagttccataagacgacaaagacttggaggttatgaaattacatgaagatagaaaacataccggcttatgagcagattttagaacaggaaattccggatattcatgcaaaaggctctttatggaaacataaaaaaagtggtgccagagtgatggtgcttgaaacagaagatgaaaataaggtgtttaatattgcatttcgtacaccgccggcaaacagtacaggggtagcgcatattctggaacacagtgtcctttgcggctcaaaagaatttccattaaaggacccatttgtagaactggtaaagggttctttgaatacgtttttaaatgcaatgacctatcctgataaaaccatgtatccggtggcaagctgtaatgatgctgattttaagaatttaatgcatgtctatctggatgctgtattttttccaaacatttatcagaaagaagaaattttccgtcaggaaggctggcattatgagttagaaaatgccgaagcacctttgaaattaaacggtgttgtttataacgaaatgaaaggggcattttcttctcctgaagaagtgttggaccgtgaagtgtttaactctttgtttccagatactccttatggtgtggaatccggaggtgacccgaatgtaattccggagttgagctattcggaatttttggaattccataaacgttattatcatccggtcaacagctatatttacttgtacggaaatatggatatggaagaacgtttaaactggatggacgaacattatctttctaagtatgatgagactgtgattgattcagccattccaaagcagaaagcctttgatacagtaaaagagctgacaatggaatatccggtttctgagaatgagccggaagaggaaaactcttatctttcctacaatattgtggcaggaaacagtcttgatgtagaacaaaataccgcatttgatattttggattataccctgttatctgcacctggtgcaccactcaaacaagcattattagatgccggtatgggaaaagatattatgggttcttatgaagatggaatttatcagccatttttctcaatcgttgcaaaaaatgcagacccaaagaaaaaagatgaatttgttgcgctgattcgcagtaccttagaagagattgtaaaaaaaggaattgacaaaaaagcgattttggcaggaattaactacatggaatttcgcttcagagaggcagattacgcttcctatccaaaggggttaatgtatggactggacgtgtttgacagctggctgtatgatgaccatcatccatttgattatctttgcaaattaaaggtctttgagaatttaaaagaaaaagcgcagactcgatattttgaagatttaatcaaagagtatttattagacaatactcatgcatcaatagtagtggttaatccaaagcgtggacttgcagcacagagagacaaagccttagaagaaaaattagaagcctacaaaagttctctttccaaagaagaagtagaaaaaatcgtggcggaaagtgcacatttaaaagaatatcaggatgcaccggaaactccggaagcacttgcaacgattccaatgttaaaacgttcggacatcagtaaagaaacgattaaaatttataatacaccgaaaaaatcaggagacacgcttctacttcatcataacattgataccaatggaatctgctatttagacctgctttttgatttgaaaaaagtgccgcaggaattaattccatacacatccatcttgaaatctgtactgggttatgtggatacagaaaattataaatatggagaactctttaatgaaattaatgccaacagtggtggcattttatttggaatacagggatttggcgattataaagataatcaggatatcagaaatatggcaggaattaaggcaaaaatgctgtataataaagtcccatttgtatttgaaatgataaaagaaatcctgatcacttctgtttttgatgatgaaaaacgtctgtatgagattattgcaagaatgaaatccagattgcagatgggacttgcacaggcaggtcacagcactgcagtcaagcgtgcgctgtcttatttttctgcaaatgcatattatcaggaacagattgcaggtgttgagttctataaagtcattgatgggctggaaagcaattttgaagcaaaaaaaggcgaattaatttccaatcttaagactttaatgaagctgattttcagagaagaaaatcttactgtcagttgtaccgcagatgaagaaggctgtaacttagtggaaaaagaacttccatcctttaaaaaatgtctgtttgatgaaccggctgaagatacggtatgcacacccatttatgaagtgaaaaacgaaggctttaaaacatccggacaggtacagtatgttgcgactgccggaaacttcagagaacagggatttgagtataccggatgcctgaaaattttaaaagtcatgttaagctatgaatatctctggatgaatgttcgagtaaaaggtggagcttatggctgtatgagtgattttaagacaagtggagacagctatctggtgtcttacagggacccgaatttgaaaaaaacgctggaagtatttgaacatactgcagattatatccgtaactttgatgcagatgaaagagaaatgacaaaatatgtgattggaacaatcagtgatcttgatgtaccgatgactccggcaaccaaaggttccgtctctttaaatgcatggttcagcaatgtgacggaagaagagttaaagaaagagcggatggaaattttaaatgcaaccgtagaagatatccgtgcacttgcagaacttgtagactgcgtcgtaaaacagcagagaatctgtgtcgttggaagcgaagaaaaaattgaacaggagaaagacctctttaagacagtagagcatttattgtaatatcggctgaaaacggtagagagaacgatagagagaccgaaataggctgagaaaaatagaaagaaaaaaggacagtgaaatgagagaagattataaatcaggctttgtcgcaattatcggacgtccgaatgtaggaaaatcgacattgatgaatcatctgattggtcagaagattgcaattacttcgagaaaagcgcagacaacaagaaataaaattcagacggtgtatacctgtgaacgtggacagattgtatttttagatacaccgggaattcataaagcaaaaaataaattaggcgagtacatggtaaatgtagcgagccgtacgtttaaagatgcagatgtgattttatggctggttgaacccggaacacaggttgggccaggagaccgtcacattgcagagcagttaaaaaactgcaaattgccggtgattctggtcatcaataaagtagatacagtaaagaaagaagaagtggcaggttttatcgaaacttatagaaaattaatcgattttgcagatattgttccggcttctgcactgcgcgcccagaatctggatacggtaattgactgcatttttaaatatttgccttatggaccacagttttatgatgaagatacgattacagaccagcctcagcgtcagattgtggcagaattgattcgtgaaaaggcactgcgtaccctcgatgaagaaattccacatggaattgcagttacaattgatacaatgaaggaacgcccggacggaagaattgtggatattgaagcaacgattatttgtgaacgggattctcacaaaggaattattattggaaaacagggggcaatgcttaagaaaatcggcagtgcagcacgctttgaaattgagcgcatgttagaacagaaagtaaatctgaaactctgggtaaaggtaaaaaaagactggagagacagtgattaccttattaagaattttggatacgataaaaaagaaatatgacagaagcaagagaagtaaccggtatggtgcttttggcagcaccggttggagattttgataagagactggtgctgttaaccagagaatatggaaaaataacagtttttgcaagaggagccagaaagccaaacagtgcatttctggccgttgcaaatccctttgtatttggaacgttttttatctatgagggaagaaccagctaccagttaaaatcagcaaggataaaaaattattttactgaacttgccaaaaagcagccaggggtctattacggattttattttctggaacttgcgtcctattattatcgggaatacatggatgcgacagagatgttaaatcttttgtatgtgacacttcgtgcacttacagtaggaaaaatggataatcggcttatccggtgcgtctttgaacttcgtgcggttttgcttaatggagaatgtccggatttcttttcctgtcaggagtgttgtaattcggaacagcttttctggttttatccggcaaaatcaggggtagtctgcgagtcctgtcacaaaaagacaaagggatatgccatcaagatggatgcctcggttttgtataccgtccaatatattgtaacttcaaagcttcaaaaattatatacatttacagtaaccgaagaagtgctggagaccctttgcaaaatgatgaaggagtacatgaaaggacaggtggacagggagttgaagagtcttgaagttttgcgggttatggagtggtagcaaaagaacacgctttacaacagggatttttatgggtataatacaatttacaggtttttcattttaaatgaaaatgatttaaaaaagcaaaagagataaggagagtattgtaaaatggaaaaaacgatggaaaaaatcgtagcactcgctaaatccagaggttttgtatatccgggttccgaaatttacggtggccttgctaatacatgggattatggtaatctcggggttgagttaaaaaacaacgtaaaaaaagcatggtggaaaaaattcattcaggaaagtccatataatgttggtgtggactgcgcaattttaatgaaccctcagacatgggttgcatctggacatcttggtggattctctgacccgttaatggattgtaaagagtgtcatgaacgtttccgtgcagataaaatcattgaagacttctgtcaggaaaatggaattgcattagaaggaagtgtagatgcatggactcaggaacagatgaaatccttcattgatgaacatcagattccatgcccaacttgtggaaaacataatttcacagatatccgtcagttcaacctgatgtttaaaaccttccagggtgtaacagaagatgccaaaaatacggtgtatttaagaccggaaactgcacagggtatctttgtaaactttaaaaatgtacagagaacttccagaaagaaattaccatttggtattggacagattggtaaatctttccgtaacgaaatcacaccgggtaactttacattccgtacccgtgaatttgagcagatggaactggaattcttctgtaaaccagatacagacctggaatggtttgcttactggaaacagttctgccttgactggctgtacagccttggattaaaagacgaagaagttcgttatcgtgaccacgacaaagaagaattaagcttctacagtaaagcaacgacagacgtagaattcctcttcccattcggatggggtgaactgtggggaattgctgacagaacagattatgacttaactcagcatcagaatgtatcaggacaggatttgacttactttgatgatgaggcaaatgaaaaatacatcccttatgttattgaaccttcactgggtgcagaccgtatggtgcttgcattcttatgcagtgcttatgatgaagaagtattagatgctgaaaaaaatgatgttcgtaccgtacttcatttccatccggcattagcacctgtaaaaatcggtgtacttccactttcaaagaaattaaatgaaggtgcattaaaagtatttgaaggactggcaaaacagtacaactgtgaatttgatgacagaggaaacatcggaaaacgctatcgtcgccaggatgaaatcggaactccgttctgtgttacttatgattttgagtctgagaacgatggtgcagtaaccgtacgtgaccgtgacacaatggaacaggaaagaattaaaatcgaagacttaaaagcttactttgaaaagaaatttgaattttaattaagcgtatctaaaaagaagagaaactctgcttaaagcagggtttctttttggcttaaatgcaagaaaatgttgtataaaaactacaaaaaactacaaaaattagcaaaataactgtgcaaaagccctataaatttcttgcgaaaaagaaaaagatttgctataatagacagcaacagcagaatttgaccagaggaggaaaacaagatggcaaaaaaaagaaatatcattgtaggtcagtcgggcggtcctacatctgtaatcaattcaagccttgcaggagtctataaaaatgcaattgagaggggatttgacaaagtatatggcatgctgcacggaattcagggacttttagatgaacaatacgtggatttatcaacacagattcatacagaactggatattgaactgttaaagagaactccgtcagcatttttaggatcatgccgttttaaactgccggaaatccatgaagataaagcaatttatgaaaaaattttttcgattttaaataaactcgatattgatgcttttatttatatcggaggcaacgattcgatggatacgattaaaaaattatcggattatgctattttgaccggacagagccagaaatttttaggtgttccaaaaacgattgataatgaccttgcactgacagaccatacaccaggatttggaagtgccgcaaaatacataggagcatccacaaaagaagtgattcgtgatgcaagcggactgacctacaagaaaaacatggttactattatggaaatcatgggaagaaatgcaggctggctgaccggagcaacagcgctggcaaaagcagaagactgtgacggaccggatttgatttacttgccggaagtaccttttgatattaaaaaatttttggaaaaagtaaaagagctgcttgaaaaacaaacttctgttgtaattgcagtttcggaaggaatcaagcttgcagatggtcgttatgtgtgtgagcttggaagttccggtgattatgtcgatgcatttggtcataaacagttgcagggaacagccacgtatctggcaaactttcttgcagcagagtgtggatgcaagacaagagcagtagaactttctaccttgcaaagaagtgcgtctcatatggcctccagagtggatattgatgaggcatttatggttggaggtgcagccgtaaaagcagccgatgaaggagacaccggaaagatggtagtcattgaccgtgtttcagatgacccatatatgagtgcaaccggtatttatgacgtgcaccgcattgcaaatgaggaaaaattagtgcctagaaattggatgaatcgtgatgccacttatgtgacaaaagacttcatagattatgtaaaaccgttgattcagggcgactatcagccgattatggtaaatggtctgccaagacatctggtgcttcgcttaaaaaaaggcaataaaaggggataaaatgtaatatttttttccattttacttgactaataatcgtcaaatgattaaaatagttagtgtgtgagcttaggctgacacagcgcggtgaaaagaagcaatttgattcatcgtatatctcactttttaggaggaatgttcaaatggcaaaatgggtttatatgttcacagaaggtaatgcaaccatgagaaacctgcttggtggaaaaggtgcaaaccttgctgaaatgacaaacctgggtcttccggtaccacagggcttcacaattaccacagaagcttgtacacagtactatgaagatggtagaaaaatcaatgacgaaattatggagcagattatggaatccatcacaaagatggaagaaattaccggtaaaaaattcggtgataaagaaaatccacttcttgtttccgttcgttccggtgcgagagcatctatgccaggtatgatggatactatcctgaaccttggtttaaatgaagaagtagtagaagtattagctgaaaaatccggcaatgctcgttgggcttgggactgctacagaagattcattcagatgtactctgatgtagttatggaagtaggtaaaaaatactttgaagaacttatcgataaaatgaaagctgacagaggcgtaaaacaggacgttgagctgacagcagaagatttaaaagaactggcagaacagtttaaagctgaatataaagaaaaaatcggcgctgatttcccaactgatccgaaggaacagttaatgggtgctatcaaagccgtattccgttcatgggataacccacgtgcaaatgtatatcgtcgtgacaatgatatcccatattcctggggaacagctgttaacgtacagatgatggcatttggtaacatgggtgatgactgtggtacaggtgttgcatttactcgtgacccggctacaggaaataacggactgtttggtgaattccttacaaatgctcagggtgaagacgttgttgccggtgttcgtacacctatgcacatttccgaaatggaacagaaattcccagaagcattcaaacagttcaaagaagtttgcaaaactctggaagatcactacagagacatgcaggatatggagtttactgtagaacatggtaaactgtacatgctgcagacacgtaatggtaagagaacagctcaggctgctttaaaaatcgcttgtgaccttgttgacgagggaatgagaacagaagaagaagcagtagctatgatcgacccacgtaacttagatactcttcttcacccacagtttgatgctgctgcattaaaagctgctgaaccagttgcaaaagcacttggtgcatcaccgggagctgcttgcggtaaagttgtatttacagcagatgacgctgtagcttgggctgcaagaggagaaaaagttgttcttgttcgtcttgaaacatcaccggaagatatcacaggtatgaaatctgctcagggtatcttaactgttcgtggtggtatgacatctcacgcagcagtagttgcccgtggtatgggtacttgctgtgtatccggttgtggcgatatcacaatggatgaagaaaacaagaaatttacattagctggtaaagaataccatgaaggagatttcatttctctggatggttctacaggtaacatctatgatggcgtaatcgcaactgttgatgcaacaatcgcaggcgaattcggcagaatcatgggatgggctgataaatacagaacaatgaaagttcgtacaaatgcagatactcctgcagatgctaaaaaagctcgcgaacttggcgcagaaggtattggtctttgccgtacagagcatatgttcttcgaaggcaacagaattgatgcattccgtgaaatgatttgttctgaaacagtagaagaaagagaagctgcacttgctaaaatccttccggaacagcagggtgacttcgaaaaattatatgaagcactggaaggtaacccagttacaatccgtttcttagacccgccgcttcatgaattcgttccaacagaagaagaagacatcaaaaaacttgctgatgctcagggtaaaactgttgaacagattaaagcaatcatcgattctctgcatgagttcaacccaatgatgggacatcgtggatgccgtcttgctgtaacttatccggaaatcgctaaaatgcagacaagcgctgttatccgtgcagcaatcaatgtgaaaaaagctcatccggattggaatgtaaaaccggaaatcatgattccacttgttggagatatcaaagagcttaaatatgttaagaaattcgtagtagagacagcagatgcagaaatcaaagctgcaggttctgaccttgaatatgaagttggtactatgatcgaaatcccaagagctgctcttacagctgatgatatcgctaaagaagctgatttcttctgcttcggtacaaacgacttaacacagatgacttacggcttctcacgtgatgatgccggtaaattcttagatgcttactatgacgctaaaatctttgaaaatgacccatttgcaaaactggatcagacaggcgttggtaaactcatggatatggctatcaaacttggtaaaccggttaatccaaaccttcatgttggtatctgtggagaacacggtggagacccatcttccgtagaattctgcaacaaacttggtctggattatgtttcctgctcaccattccgtgtaccgattgcaagactggcagcagctcaggcagcaatcgctgaaaaaaatgcataatttgttcatgtaataacatgataaaagcataaaaaatgaccttggaggtctgaagtaattcaggtcttcaaggttttttgttttaaaaagaaaaatcaaaaaagaaaggaatagagatattttatgacacaggaatcacaacagccacataaaagaagagtacgctataagggaaaatatccgaaaaaatttgaggaaaaatataaagaattacagcctgaaaaatatcaggacacgattgcacatgtcatcgggaagggaaatacacctgccggtatgcatatttcgattatggtaaaagaaatccttgattttttggaaattaagccgggtcaaattggctttgatgccacacttggttatggtggtcatacaaaagcaatgttagagtgtttaaaaggcaaaggacatatctatgcgacggatgtagaccatgaggaagcagagaagaccagaaagcgattagaagaagcaggatttggtgaggatatgttaacgattaaacttcagaatttctgtacaattgatgaaattgcaaaagaagtcggaggttttgactttttacttgcagaccttggagtttcttctatgcagattgataatccaaagcgtggtttttcttttaaggtagatggacctctggatttgcgtctgaatcaggagacaggaatcagtgcggcagaacgcttgaagacaattacaaaagaggagcttgccggtatgctctatgaaaattcggatgagccatactgtgaagaactggcaaaagcgattaccgacgaaatccgaaaaggaaatgcgattgatacgacaacaaaattgcgggaaatcattggaaagactttggattttcttccggaaaaagaaaagaaagagaccattaaaaagacctgtcagcgaacctttcaggcacttagaattgatgttaatcgtgaatttgaagtgttatatgaatttatggaaaaacttccggatgcattgcgcccaggcggaagagcggcaattcttacttttcattccggagaggacaagttagtaaaaaaagcgttgaagcaaggctacaaagacggcatctatttggattatgcaaaagatgtgattcggccgtctgcacaggagtgtgcacaaaacggaagggcacgttctacaaaaatgcgttgggcaattaaagcgtaaagaaacaaaaaagagagcaaaaatctttaaaaatcggctaaaaacgccgaaaagatggatggctctcttttttgcacaatatttttttgcattttgaaaaaaactatgatatgattaagcacatacaagagaaaatatcaagttcttgtcagagtctgacaaatttcctatcgtttaagaagaataaaaactgaaaatagcaatacttgaaaagagggttataaatagtatgagagaaaagtatttgtccttgtcattaggcacattgaaggagcttgcaaaagcaaggggaatgaagggtatttcgacattgaaaaaaagtgaactgattgaacgaatgttgcaagaagatgaaaaagagaaaaaaatagaaaaagagaaaaaagtagagaaagaagaaattttaaatacgcagcctgcaacaaagccagaaccacgttcagatcgtccacccatggagcaatctgaattagacagcggaatctgtgtaaaaggaattttagaagtacttccagacggatatggttttatccgaagtgataattatctgccgggtgagaatgatgtctatgtttctccatctcagattcgtagatttaatttaaagacaggagatattttaaagggaaatacccgagtaaagagtcagaatgaaaaattttcggctctgctttatgtgacatccattaatggaatgaagccaaatgagatgcgtcgttataattttgaagatatgacaccgattttcccaaatgagcgtctgcatttagaacgtccgggtggaagcgtagcaatgcgagtggtagacttagtcagcccaattggaaaagggcaaagagggatgatagtatctcctccaaaggccggaaaaacaacattgttaaaagatgtggcaaaatcaattttgaaaaacaatcctgagatgcatctgattattttattgattgatgaacgcccggaggaagtaacggacattaaagaagcaattaaaggttcaaatgtggagattatttattcgacctttgatgaactgccggaacaccataaacgtgtatctgaaatgacaattgagcgtgcaaaacgtctggtagaacataaaaaagatgttacgattttcatcgacagtatcaccagactggcaagggcgtataaccttaccgttccgccgagtggaagaactctttccggtggtcttgacccggcagccctgcacatgccgaagcgtttctttggagcagcgagaaatatgagagagggcggaagcctgactattcttgcgactgctttagtagataccggaagtaagatggatgatgtggtttacgaagaatttaagggaacaggtaacatggagctggtgttaaaccgaaaacttcaggaaaaacgaattttccctgcgattgatattgcaaaatccggaaccagaagagaagacttattattaagcaaagaagagcttgaagcagtggatattatgcgaaaagcattaaatggaatgaagtccgatgaagcgcttgagaatatcttaaatatgtttgcacatacaaaagataataaggagtttgtacagacagtaaaaaaacaacgttttctctattaaggcttgcatttccaaaattactatgatataatttaaaagctgtttggaattagaaacgcaaaattaatactccatcgaagattctgtttatcatggaaactttgcgtggatgcgcctggtctgtttggttttgtattttgtaccaggtgccggaaggtataaataataaattttttagaagaggtgaaaatcatgaaagaaggaatccatccaaattatcaggaatgtacagtagtatgcaactgcggaaatacttttacaactcgttctgtaaaaccagaacttcgtgttgaagtttgctccaaatgtcatccattctatacaggacagcagaaagctgcacaggctcgtggccgtattgataaattcaataaaaaatacggaatggacaaataagaaaacaaataagagaggctggggttttcggacttcagcctcttctttcgtttcagaggagttttatatatgaaatcatcaaatattggtggacaggcagttatggaaggcattatgatgcgccataaagacgtctattcgattgcagtccgtaaaccggataaagaaatcgaagtaaaagtagaagactacaaaagcgtcatgaaaaataaaaaaatcctctctctgccaattataagaggtgtgtttagttttattgattcccttgtaattggtacaaaatgtctgatgtattccgcttcattctttgaagaggaagaagaggaaaaagcaaaaaaagaggcattaagcggggatgagcttacaaaatatgaggcaaaacagaagaagcaggaaaatgtcttaatgacaattacgatgattttttctgtggtgatatcggttggactttttatggtgcttccgtatttgattgccagtcttttaagaaaagtgggagccggtgaatccgcagtaacagttgcagaggcatttatccgaattgtattgtttttagcttatctggttctgatttccaagatgcaggacattcaaagagtctttatgtatcatggagcagaacataaatgtattaactgcgtagagagcggaaaagcgcttaccgttgaaaatgtaatgaagagttcccgttttcataaacgatgcggaactagttttctgttctttgtcattattatcagtattattttctttatcggattttttgcgattgtgccggtcaaaacaatgtggatgcgtgttgtgattcgtgttctgcttgtgccggttgttgcgggtgtttcttatgaatttatccgccttgccggaaacagtgaaaataaagttgttgcgctgttatcaaaaccgggactttgtatgcagaaacttacgacaaaagagccaacaccggatatggcagaagttgcgattatggcagtagaagcggtatttgactggaaagtatatctgcgagagaattttgaaaatgccgaaggagaaataaaaaaagcagaagaggcagaacatacagcaggagaagcaaatgataacttatagaactctgctttcggagggaaaagaagtccttcaaaaagcaaagataatggattttgagatagatgcatggttgttaatggaatttgtatttcaaattgaccgtgcccgcttttttctggaacaaaatgaaacggtggaagaagaaaaagcagaaacataccgcagtctgttagccgagagggcaaaacatattccggttcagcagattacgcatgaagcatggtttttcggtctgcctttttatgtcaatgagaatgtgctgataccaagacaggatacggaagtgttgatagaagaagtgctgtcagctgtaaagaagtatagaatacagacaccaaaaatcctggatatgtgtacgggcagtggatgtattttgctgagtctgcttgtaaatatagaaggcgcagagggacttggagcagatttgtctgaaaaagcacttgaggttgcacaaaaaaatggcagtctgctgaatttaaaagcagagtggtgtttaagcaatttattttcccatataaatggaaagtatgatataatcgtgtcaaacccgccttatattgagagtgcagtgattgaaaccttgatggaagaagtaagggaacatgaaccgagaatggcactggatggtaaggaagatggtttgtatttttaccgtgaaattacaaagcaggccggagtttatctaaatgccggaggaattttagcatttgagattggatataatcagggagaagcagtcagccaaatgcttaaagaagaacaatatgaagaaataaaagtagtaaaagacctggcaggacttgacagggtagtaattggaagaaaaaaacaggaggattcccatgtttgataaattagatgatattttaattcgtctggaagaagtattaaatgaattaaatgaaccgacagtggcaaatgacactgtaagatttcagaaactgatgaaagaacaaagtgacttacagccgattgcagacgcttatacagagtataaaaactgtaagcagaccgtagaagacagcctgatgatgttagaggaagaaacagatgaagagatgaaagaaatgctcaaagaagaactttctgatgcaaagaaacgaatcgaagagttagagcatgaattaaaaatcttattacttccgaaagacccgaatgatgataaaaacgtaattgttgaaattcgtgcaggtgcaggtggagatgaagctgcgttgtttgcttctgaaatctatcgtatgtatgtaaaatttgcagagtctcaaaactggaaaacagaaatgctcagcttaaatgaaaacggaattggcggattcaaggaagttacctttatgattaccggacgcggtgcttattccaaattaaaatacgaaagtggtgtacatcgtgtacagcgtgtgccggagacagaaagtggcggacgtatccatacttcaaccattacggttgcaattatgccggaagcagaagaaatcgatttccatctggatatgaatgactgtaaattcgatgtattccgtgcctcaggaaatggtggacagtgtgtcaacacaacagactctgcaatacgtctgactcatatcccgacgggaattgttatttcctgtcaggatgaaaaatcacagttaaagaataaagataaagcattgaaaattcttcgttcccgtctgtatgagatggaactggaaaagagacatgatgaagaggcagaagcaagaagaagtcaggttggtacaggagatcgttcagagaaaatcagaacttataatttcccacagggacgagtaacagaccacagaattaagttgactttacaccgtttagattctattatgaatggagaccttgaagaaatcatcgacagtctgattgcagcagaccaggcagccaaactgagtaatctgcagggtgaagaataaaaaataaatagttttaagtgttattttaatcttaaaagataggagtaaatagcgatgggaaaatattttggaacagatggttttcgtggagaagcaaatgtaaatcttacagtagaacatgcttataaagtaggacgctttttaggatggtactatggacaggcgcataaagcgcagattgtaatcggaaaagatacaagaagaagcagttatatgtttgaatattcactggtagcaggtctgactgcgtctggtgcggatgtatacttactgcacgtaacgacaactccaagtgtttcctacgttgttcgtacagaaggatttgactgcggaattatgatttctgcaagccacaatccattttatgacaatggtattaaggttatcaatggaaacggacagaaactagaggcttctgtagaagcaaaaatcgaagaatacattgatggaaaaataccggaacttccatttgcaaaaagagaggacattggacgtactgtagatttttcagcaggaagaaatcgttatattggatatctgatttccattccgacccgtgcatttaaaaacaaaagagtgggtctggactgctcaaacggaagcgcttctgcaattgcaaaaagtgtatttgacgcattaggtgcgaaaacttatgtcattaataatgagccggatggaacaaacattaatatgaactgtggttctacccatattgaagtcttaaagcagtttgtaaaagacaatcagttagatgtcggatttgcttatgacggagatgcagaccgctgtatcgcagtagatgataagggcgaagaaattaatggagatttaattctttatgtctgtgggaaatatatgaaagagcagggcaaattaaacaacaatacgattgttaccacaattatgtccaatctggggctgtataaagcctgtgacagagaaggaatttcttacgaaaagacagcagttggagacaaatatgtctgtgaaaatatgatgcagaatggacattccatcggtggagaacagtccggacacatcattttttccaaacatgcgactacgggtgatggaatcttaacttctctgaagattatggaagttattatcgaaaagaaactgccgttaagtacactggcatccgaagtaaagatttatccgcaggttttgaaaaatgtgcgtgtgtatgataaaaaagaagccagagaaaatccggaagtggtaaaggtaattaaaaaagtagaagaagcactcggagaggatggaagaatccttgtaagagaaagcggaacagaaccggttgtacgtgttatggttgaggcatctacagatgaaatctgtaatcagtatgtcgatgaagtgattgcagtgatgagagcccagaatctggttcagtagaaatgaggaacagtgagtgaacagaaaatatagaagaagtttgatagttggcggatgccttctttgtctgctgactggctgtgcaggtaatcagaacagtaattatgagcagggtgcactggatttggaaaataaagaatatgaaagtgcaattgaaaactttgaactggcagtggcagaaaaagagcacaccgcagaagcgttaagaggagaaggaattgcctatcttcgattcggaaattatgaagaggccgagaaagcgttttcctctgcattaaaaaaagcagaaaaatcaaagacagaggtaaagacagatattttatcctatctttcctcggtagaatataagctggcagactatgagagtagtttaaaacatgcagaggcactgatggatttaaaagaaagcaaggaagctcatttcttaaaaggaagtgcagaactgcatcttgaccagtatgatgatgcaaaagaagatttttcaaaagtgatagaaaaatcagaagattatgatgattatctgcaggtttacaaagtttatgcagattatgacttgaaagcagatggcgcatcttatctggaacaggcacttgaaattgacggaacaggcaaagaagacgcttacaataaaggcagaatttattattatctggaagaatatgacaaggcaaaagaagaactttcgagttcttatgaagatggatataaagatgctgcaatttatcttggaaaggtttatgcagagctgggtgatattgataatgcaaaatccatgtatcaggaatgtctgaacgaaaaaggctatcaggcaaaggcttataatggattggcatactgtaatattttagaagaagattatgcttctgctcttaaaaatatccaaaaagggctggatgcaggagatgaagaagaaaaacagggactactgtttaatgaaattgtagtctatgaaaagacttctgattttgcaactgcaaaagaaaaaattgcagagtatttaaaattatatccgtccgatgaaaaagcggtaaaagaaagttattttctggaaaccagataaataggagattagatggaattatttgatttaagtgataaaaccgagcgtgtcatcttagtcggtgtacaggaaaatgacggagatgatacggaagaatcgcttcaggagctggcagaacttgcaaaaactgcaggagcagaagttgtaggaacagtcattcaaaagagggaacggattcatcctgggacttatgtcggaaaaggaaaaatcgatgaaatccgtactctgttaaatgcacttgatgcaactggaattatctgtgatgatgaactgagtccggttcagatgaatcatttacagcaggaactggaatctaagattatggaccgtaccctgttgattctggatatttttgcaagccgtgcagtcacgaaagaaggaaagattcaggtcgaacttgcccagctccgttaccgtgcggtgcgtctggtcggacttggaagttccctttcaagacttggaggcggaattggaacaagaggaccaggagagaaaaaactggaaatggaccgtcgtctgattaaagagcggatttcccagttgaaaaaagagctggaacatgtgaaaaagcatagagaactcttaagagaaggacgaaaaaaagaccgcgtgatgactgctgcaattgtaggatataccaatgcgggaaaatcgacgctcttaaataccttgacggatgcaggcgtgttatctgaagataaattgtttgcaacgttagacccgaccactcgcctgttagagttagatggtggacagaggatttatctgaccgatacggttggatttatccggaaacttccacatcatttgattgaagcatttaaaagtacactggaagaagcaaagtatgcggatgtgattttgcacgtagtagatgcatcaaatcctcaggtagaagagcagatgttcatcgtctatgaaactttgcgggaactgggtgtaaaggataagacaattgtcacgttatttaacaagcaggatcgtttggcaggtaatgagattcttcgggattttaaggcagattatgttttaaaaatctctgcgcgtaccggtttgggtctggatgaattaaaaaatacactggaaaaaattttgattggaaatcagatttatatcgaacgtgtgttagattataaagatgccggaatgttacagctggtacgaaaatacggtcagttaattgaagaaaaatatacagaaaatggaatcgaaatcaaagcaagagttccaaaagatatctatggaagacttggagaataaaagagttttatgaagattaaaataccatatatggtggaatgtaaaaaaattcaacccatatatggtattttttacggttgacttctccaggggcatttgctaaaatgaatctacagcgtttcaaaacaaggcgcaaacgaggaggaatgaaaagtatgtttcaggtagtaaagcgggatggagaaattgacaatttccgaatagacaaaataacaaaggccatcaaaaaagcatacgatgcaaccaataaacaattcagtgacgatatgctagacatgctggcacttcatgtgacatctgattttcagaaaaaaatcaaaaaaggaaaaatttctgtagaagatattcaggacagtgtggagaatgtactgattcaggcaggatatgcagatgttgcaaaggcatatattttataccgtaaacagagagaaaaaatccgtaacatgaaatccacgattctggattataaagagattgtcaacagctatgtaaaagtagaggactggagagtgaaagaaaactctaccgtgacatattctgttggtggattaattttaagcaactccggtgcagttaccgcaaattactggctctctgaaatttatgacaatgaaatttcagaagcacacagaaatgccgatatccatattcatgatttgtctatgctgaccggatactgtgccggctggtctttaaaacagctgattcaggaagggcttggcggaattgaaggaaagattacttctgcgccggcaaaacatttaagcgtgctttgtaatcagatggtgaatttccttggaattatgcagaatgaatgggctggtgcgcaggcattttcatcctttgatacttaccttgcaccgtttgtaaaagcagatggattaagctataaagaagtaaaaaaatgcattgaagcctttatttatggagtgaatacaccaagccgttggggaacgcaggcaccattttccaatattacattagactggacggttcctgatgatttggcagagcttcctgcaattgtcggcggcaaagaaatgccgtttaaatataaagactgtaaaaaagaaatggatatggttaataaagcatttattgagaccatgattgagggggatgccaatggacgaggattccagtatccaattccgacttattctattaccaaagattttgactggtctgataccgaaaataaccgtctgctatttgaaatgacttccaaatatggaacaccgtatttttcaaattatattaacagtgatatgcagccaagtgatgtaagaagtatgtgctgccgcctgcgccttgatttacgtgaattaagaaagaaaacaggcggattctttggctcaggagagagtacaggttctgtcggtgttgtaacaatcaatatgccgcgtattgcataccaggcagaagatgaaaatgattttatgctgcggctggatcgtatgatggatatctcagcacgttcattgaaaatcaagagagatgtaatttccaaactgctcgaggaaggtttgtatccatataccaaacgttatctgggaagttttgacaatcatttttccaccattggattagtaggtatgaatgaagccggattaaatgcaagatggctcaaatgtgatatgaccgatgtgcgtacacaggaatttaccaagagagttttaaatcatatgagagagcgtctggtgatgtatcaggaagaatatggtgacttatataatctcgaagcaacaccggcagagtcaactgcttatcgtctggcaaaacatgacagagaacgctggtcggatatccgtactgccggaaaagagggagatacaccatattataccaacagctctcatctgccagtggaatatacctccgatatttttgacgcactcgacgtacaggatgaacttcagaccctttatacttccggaacggtattccatgcatttcttggagaaaaacttccagactggaaagcagccgcttctctggttcgcaaaattgcagagaattataaactgccgtattatacgctgtctccaacttattcagtatgcaagacgcatggctatattgcgggagaacattttatttgtccaaaatgtggagaaaaagcggaggtttacagccgaattaccggttattatcgtccggttcagaactggaatgatggaaagagccaggaatataagaatcgtaccgtatatgatatcttacattctaatttgaaagcaaaaccggcagaacaaaagcttgaacaagaacagccggtgaaaacagaacaagaaacagttgtggaaactgcaaaagaagaaaaatacttatttacaacggcaacctgtccgaactgtaaaattgcaaaaaaaatgcttgagggagaagagtatcagatcatcgatgcagaccagaatccggaaatggtgcgaaaatttggaattatgcaggcaccgacgctggttgtgtttgatggggacaagatgcataaatatgtcaatgcatcgaatattcaaagatatgtagaccagatgtaagaaacaagacataagataagaaatgaagatatagataaaagaaaagcgcttcagcgagaaagtaaatcactcgccggagcgctttttgatagctttaaaatttgatggttttgcaatctattaaaacttagttctgtttttcattttttaattcggccattttcatagcacgaacttttaacggaagaccaaacagagtgataaatccatctgcatcgtggtggtcatacaggtcacctgttgtgaaagaagcaagggattcgttgtataagctgtatggagaagtggtaccggctttgatgatgttacccttgtacagtttgaatttaacttcacctgttacatattcctgagtggaagtaacgaatgcctgaattgcttcacgcagcggagtgaaccattttccttcgtatacaacctgtgcgaactggcttccgagtttcttctttgtttccattgtttcacggtcaagaatcagttcctctaactggtcatgagcagccattaagattgttccgccaggagtttcatatacaccacgggatttcataccaacaacacggttttctacaatatcaatgataccgataccgtgttttccgccaagtgtatttaattcagtgatgatttcagatactttcatggattttccatttaaagaaaccggaacacctttttcaaatgtcatagtaacatattctggtttatctggagctttttccggtgtaacactaagaacgagcatatcgtcatagtttggttcctgagatgggtcttccagttcaagaccttcatggctgatgtgccataagttacggtcacggctgtagctgtggtttgcatcgaatggaaggtcaattccatgtgctttacagaattctaactcatcttcacgggactgcatagtccatacatcagtcatacgccatggagcaatgattcttaaatcaggagcaagtgctttgataccgagttcaaaacgaatctggtcatttcctttaccggtagcaccgtggcagatagcagaagcgccttcttttcttgcaatttcaaccagtttctttgcgataaccggacgagccatggaagttccgagtagatatttgtgttcatatacagcacctgcttcaacacaaggcatgatataatcatcacagaattcatcaacaatatcttcaatatataatttagaagcaccggagagttttgcacgttcttccagaccgtctaattcatttccctgtccacagtttacacaacagcagattacttcataatcgaagttttcttttaaccacgggattaaagcagttgtatcaagaccgccagagtatgctaaaataactttttctttcatgataagtttcctcctaagatttataaaaataaattttaaaaatttcaattatgtttttcaacacggtttactatacaacaactattataattatgcaatagaaaattgaaaaaagtgtaaaaaaaataaaaaaacaagcaaataaaaggtcgaatcaatacctattttaaatgtaaaccaaatgaaattgcagaaaatgaaaaaaatcaaaaataggggttgaatattatgcataaaagatgtattattatgcaatcggagcgaatcttatgcataaaaaataaaaatatcgcataaaaacaggattcttggactttactcaaatgaagaactgcggtattatggtaaagataaagatataatcagggagtgtgttccttaaaaaaaatcgttaaaagagaggttgggaagatatgataaaagcaggaataataggtgcaaccggttacgccggaggagaattggtaagattacttttaaatcataaagatgttgagattaaatggtatggttcaagaagctatattgataagaaatactatgaagtatatcagaatatgtttcagttagtggatgacaaatgcatggatgataacatggatgcgttagcagaccaggtagatgttatctttactgcaactcctcagggactgtgtgcttctttaatcaatgaagaaatcctttcaaaagtaaaagttattgatttaagtgcagacttccgtttaaaagatgtaaaagtatatgaagaatggtataaaattgaacacaaagctccacagtatattgatgaagcagtttatggactttgcgaaatcaacagagaacaggtgaaaaaagcaagaattgtagcaaatccgggatgctatacaacctgcagtattttaacttgttatccgttagtaaaagaaggattgattgacccgtctactttaattattgatgcaaaatccggtacatccggtgcaggaagaggcgcaaagattgataacctgttctgcgaagtaaatgaaaatatgaaggcttatggtgttgcaacacatcgtcatacaccggaaattgaagaacagcttggttatgcggcaggaaaacagttctgcatcaactttactccacacttggttccgatgaaccgtggaatcttagcaactgcttatgcaaccctgacaaaagatgttagttatgaagaggtaaaagcagtttatgacaaatattataaagatgaatatttcgtacgtgtcttagacaaagatgtatgcccgcagacaaaatgggtagagggaagcaactttgtagatgtcaattttaagattgacaagagaacaaaccgtatcattatgatgggtgcaatcgataatcttgtaaaaggtgcagcaggacaggcagttcagaatatgaaccttttatttggatttgaagaaaatgagggcttaaaattagttccgatgttcccgtaaattacagaaatagcattgtaatagagcaatcaggggatattataattaaaaaaataaaattaaaagaagtacacgtcaggaggaacactcatgaaagtaatagaaggcggtgtaaccgcagcacagggatttttggcggcaggactttccgcaggaatcaaaaaaggaaatacaaaagatatggcaatgctttacagcaaagtaccttgtgaagccgcaggaacttttacaaccaatattgtaaaagcggcaccggtgaaatgggatcagaaaattgtatatgaatcagaaaaagcgcaggctgtcatctgcaacagtggaattgcaaatgcctgtacaggagaagagggctttggctattgtaaggaaactgcgaaggcagcatctttggcattaaacattccggaagattcagttttagtggcttctaccggtgttatcggacagcagattccgattgaaaagattaaaaaaggaatcgaaaatatggctccgttactttcagaaagtatcggtgcaggaacacttgcagcagaagcaattatgacaaccgataccgtaaagaaagaaattgcagttgaagttgaaattgacggaaagaacgtaaccgttggaggaatgtgtaaaggttccggtatgatccatccaaatatgtgtaccatgcttggatttatcacaacggatgttgtaatttcaaaagaactgcttcaggcagccttaagtgagagcgtaaaagatacttataacatggtatccgtagatggagatacttccacaaacgatacggtattattacttgcaaatggacttgcgggaaataaaaaaatcgagacaaaagaagaagattataaaaagtttgcggaagcattaaattatgtcaatacctggttggcaaaacatattgcagcggacggagaaggcgcatccgccttatttgaagtaaaagtgattggtgccaagtcaaaagagcaggcagtgacgttaagcaaatccattattacatcgaatctgacgaaggcagcaattttcggtcatgatgcaaactggggacgaatcttatgtgcaatgggctattccggtgcagtatttgaccctgaaaaagtagatttatattttgaaagcaaagccggaaaattaaaaattattgaaaacggtgtggctaccggatatagcgaagaagaggcaaccaaaattctttcagaaaaagaagtaacagcaattgcagatgtaaaaatgggaacagctacagcaactgcatggggctgtgacttaacctatgattatgtaaaaattaatgcggattaccgctcataaaagtacaaaaagaaacagatggaggaacgggagaacatggtaaatcagaaatatcttgaaaaagcagaagtacttattgaggcacttccttacatacagcgttttaacagaaaagtcattgttgtaaaatacggcggaagcgcaatggtcgatgaagaactcaaaagaaatgtcatcaaagacgttgtactgttaaagttagttggatttaaaccgattattgtacatggtggtggaaaggaaatcagccgctgggtaggaaaagtcggaaaagaagcaaaatttgtaaatggacttcgtgtgacagataaagaaactatggaaattgcagagatggtgcttgggaaagttaataaagaactggtcactttagtggaatctttaggagtaaaagcaatcggaatcagtggaaaagatggtggactcttaaaggtaaataaaaaactttctcagggacaggatataggatatgtaggagatataaaagaggtcaatccagcaatcttaaatgaattacttgaaaaagattttctcccgattgtctgcccggttggtcttggtgatgattttgcaacttataatattaatgcagatgatgcagcctgcgcaattgcacgcgcaatgaaagcagaaaaactggcatttcttacggatatcgaaggtgtttatagagacccggaagatacatccagtttaatttcagagctttttgtaaatgaagcaaaagcattaatcgaaaatggaaatgtcggtggtggaatgattccaaaattgcagaactgtattgatgcaattgagtccggtgtaaatcgtgtacatattttggacggaagaatccagcactgtctgttacttgaaatctttaccaataaaggaatcggaacagcaatcttaagagaaggcgagggaaagtactacaatgaagaaaacaagtagtgaatatatggaacaaacagaagagtatgtgcttcatacttataaccgttttccggttgtaatggaaaaaggagagggtgttcatctatatgatgtagatggaaaagaatatctggatttcgcagcaggaattgcagtatttgctcttggatataaaaatgaagactataatcaggcattaaaagatcaggtagataaagtcattcatacttctaatctgtattatcatgcaccgcttgcagaggctgcaaaaaaagtagtagaagcaactgggatgagcaaagtattctttacaaacagtgggacagaagccattgaaggagcaattaaagtagcaagaaaatatgcatggttaaaagatggttcaaatgaccatgaaattattgcaatgcagcactctttccacggaagaagtttaggcgcacttgcagtaacaggaaatgcacattaccaggaaccgtttaaaccattaattggcggaattaaatttgcacagtataatgaccttgaaagcgtaaaagcacagattacagaaaaaacgtgtgcaattatcttagaaactgtacagggtgaaggcggaatctatccggccaaggcggaatttttaaaaggaatccgtgccctttgtgatgaaaaagacattttgcttatcttagatgaaatccagtgtggcatgggccgtaccggaagcatgtttgcttatcagcagtatggtgtgatgccggatgttgtaaccgtagcaaaagcattgggatgcggtattccggttggagcatttgtcttaaatgaaaagacagcaaaacattctttagttgctggagaccatggaacaacttatggtggaaatccactggcttgtgcagcagtgagcacagtatttgatttgtttgaaaaaaataaaattgtagaacatgtcaaagaagttactccatatctggagaaaaagctggatgaactggttgaaaaatatgactgcttcactgcaagacgaggaaaaggttttatgcagggactggttgtagcgggaagaccggtttcagaaattacttctaaggcacttgaaaacggactgcttgtgatttccgcaggaagtgatgtactgcgtcttgttcctccacttgtcattactgaaaaagatattgatgagatgatagaaaaattagagaagagtctgtaagatacaaaagttagagaaataaatatagggtaaaaaatagaataaaataaagaataaaaaaatccttctgcggagattctaaaaagaaaaatgataattagaataattatacttagaacaacgtggagggattttttatgtggggaattttaacagcgctgctttccggagcattgatgagtatacagggtgtgtttaatacaaatttaactaaacagacgagtctgtggttggcaacaggctgggtacagattacggcttttcttatctgtgtgggagcatggttttttaccggaagagaaccgattggaaaattaatgaccgcagagccgaagtatattttagcaggaggcgtgattggtgcatttattacgattacagtcattcaaagtatggcggggcttggaccggcaaaagcagcaatgttaatcgtgatttcacagcttgtagtagcctatttaattgaattacttggaatttttggaatggaaaaagcttcctttgaatggagaaaggtaattggaatggcagttgcaattggtggaattattttattcaagtgggaatcttgacaggaggcagaagcagagttttttgtcgaacgtattttcttgcctttttaaaatagagcggatataatagaagcgtaaaaatagaggggtgtataagaaaaagaaagtaaaatggaaggggtcaggatatgagtgagtccggctatttggtttctcaggcatcaaaacttcttgaagtgcagtctcatgtgcttcgctactgggaagaagaactgttattaccgataggaagaaatgaactgggacaccggtactacacccgatatgatatacaggttattttgtgtattaaagaactgaagaaaaaaggtttttcattgaaagagataaaaaaagtaattccgctgttttatgagactgtaaaacaggaagaaacaaattcgaaaggagatgatttagaaagagaagtattagaaaaagaaaattcacaaagaatttcagaaataaaaaacttagaaaaagcagagagaaagttcgagacagccgtaaattctgtaagtcgttctgcatattctggaaaacgtaaaaaagcgcagaaagcagcaagagcgagggaacaaaaaaagaaaaaggaacagaacagacagacgaacaaaccagatgggcaggagagcggagtccctaaagagtttatggaaattttgaaccggattgtaaaagagcggatgaaagagcaaaattaccggaatcaggaagaagaaaaatgtaggaagctggatgaaaaaataagaatctgtcagaaagcaagaaaagaggttgcagtggcagtagaaaaagaaaaacaggaaaaacatcattttttccgaaaaaaaaagagtgatgcatgaagcaccactcttcatttttgtaatagctttttaataaattagccttctacgatagcttctgcaggacagacaccagcgcaagttccgcaatctacacattcatcagcgttgatttcgtattttccatctccttcagagatagcgcttactggacattctccttcacaagttccacagcttaaacattcatctgtaattacatatgccataataattatcctccttatattctctgaacttcatagctcagtttatatgcatattctaatatatttagattgagaatacaagtctttatttacaaacaatttgtgaaaaaaattatcatcttataaattcagataaaaatagttgaatatcgggggaaaaacgtttataatagggacgtacgaaaattaaggaggaaatgaagaatgacaatttctaaagatatgacaattggcgaattaatccgcacagatgaaaatattgttccgattcttatgagagcaggtatgcactgcatcggatgcccatccgctcagggtgaaagcttagaagaagctgctatggttcatggaatcgacgcagatgttttaactgcgcagattaatgattttttggcaaacaaataagaattaagccgaataattgtgagatttggtaaataaaatgccatcgggaaaattatcctgatggcatttttaagtctgttttataaatcagcaagttgttctaacgcatgaccggaaagaatacagtcagcatgttcaatcagatgtgcttctccggctaaagagaatggttttccacttccatattcggagagcatgttgcagactttattaaaatcagatggagagcttccggactgatggagcactaaactgtattcttctgcaaagtcatctttatataaagaattttttccggtaaagaaatgattcaatgctttggaagccagaattacatcatcaagtgtacggaacgtgaagttgcggattaaatcaagcttgatttctgtatcctcttcggaagtttctgatttagcagaggatgcagatgctgtattggtttcagaagaagcaggctgtggtttggaagatttcttttttgcggcagctttgcttcttgcatcataaactttttggaagaggtctaaaatatcatctgctccttcaatagctggaggggcggaaagcgtatcatttccggaagaagaaaacggtgtaaattttgaaaaacgggtatctaactcgtcagggtcttctacttttgtaatgattaagacgatactgtccattgaaattggaattgcctcaatcataagaggaatattgtccgcttcaaatccaaattcaatgtttgcctgctgcatcatatcacgaaacagacttttggctttctctgtgccataggcaagctcacttaaacgaatctggcggtcttctaaatccgcttttgttaaagtgcatcgaatctgattttcattaattttttctattttcataaatatcacatcctgtctcaaactattctacaatcaaaagaatatactttttcatttatattatatactatcaaaacgaagaatgtaaagcagttccttgttttttcataaatcttccgaattttaagtaaaaatgcttgtgggaaagcggggagcatggtatagtaatactacagataaaaaggctgggcaggttttatggaaaggaggataaaaaaacttcaaatcctttatttagtcgaaagccaaatagaataaaagcaaatgaattaatgctagaaacaaattcatttatagaaacaaatcaaaataatctgagacaattttctaatcatataaccatctggttaaatcggaacattcattcagaatgtctgtagaaatttccaatttgaaagaacaaaatataagagcataaacataagaatataaaaaaatcaaaaaacgtcaaagcttttttgtctgtaaggagatttgcgcctgtgccaaatatcagaatgttacatatctgctattttgtttctgctgttatcatatatcacaaatatgtattctgtgaatacacaaatacagaaaggcagaaaaagtgtatgagcaaagaaaaagaaccatccccgcttgggcgtgaactggaaacctatcaaacagaaggaattccgctgtggctgaacggaaaaccaagtacgccggaagaaatcgtgcatgcctgcatgattgaagaagaaggtacttatatgcgggattatgtgcagaatgaaagggggaaagtggaacggcttgaatttgatttgataaaattaaaaaaagaagaaacataaaaataaaatgctataggtccccgcttaggcataaaagaaaggctgctgctttcatgaataaaaattcggaaagtagcagtctttttgattttctctgaatcttaaaaaaacataaattgtcgaagaaagataatgacggaagcgaaaagtatgttataatgaaaaagaatttgaagataaggagcgcaaaatgagtggaaaaaaaagaaaagaaatggttcctgtcattgttgtgattttattgattgtactggttggatgtgtgggtgctttaaccgcagttatcaaaagaatgactccgtcggatgagaggatggacgttcgcacttattatgggctgacttcggatgacgatgtcgctctggttttgcaaaacacagtcagtgatagaaaagcgaaaatgatagacggacatatttatctggattatgatacagtatccgatgttttaggtggacgtttctactgggatgaagcaaatcaaaagatgctttattcaacaccgtcagaagtgatttcaatttcaccggacagtaatacttatactgccggaggaaaagaaaagacagaagaatatcctattatctgtgaaaaagaggataccatatatctggcattggaatttatcgaacaatacatgcagattatggtgacaaagagtgagaatccggataaagtgattatttcttataaatttggaacacaaaaaacggtaacagtaacagaggatacggtagttcgttatcgcggtggaattaagagtgaaattctaaccgatgttaagaaaaaggataaactggttctgctggagacactggatgaatggtcaagagttgcaacggaagatggatttgacggttatatcaaaaatgacagtatttcagatgcaaaggaagagaaaatcgagtatcagggcgaatttaatgaaacttatacaagcctgaccagagattataaaattaatttagcctggcatcaggtaacttccgaagatgcaaataaggcattatcagaagtactttccggaacaaagggaattaatgtgctttcccctacctggttttctgtgaccggaacagatggtgcaatttcttcgcttgcaagtgcggattatgtaaagactgcgcatgaggccggaaaggaagtctgggggctggtcgataattttaattcgagtgtcagtacacttgcaacgctttcaaataccgcttcaagaaatcatctggtagagatgcttctttcagaagcaaaacgggttggactggatggaattaatgtggattttgagtctatgacgaaagaggaagcccctcattttattcagtttatccgtgagctttctatcggatgcaggaaaaatcagcttgtgttatctgtggatgatccggtgccggaatttacaacttactataatcgtaaagagcaggggattgtagcagattatgtgattattatgggatatgatgaacatacggaaggctcagaaaaagccggttcggtggcatctcttccgtttgtggaaaaagggattacgcagactttaaaagaagttcctgcaaataaagtaattaatggaatgccattttacaccagaatgtggtatactgatactactggcagtgtgacgagtgaaattcttggaatgagtcaggctggacagtcagtagaaaatatgggaatgacctctgcttgggatgaaaaaacttcacagaactatgcagaactggaaacaggaagcggaaaataccagatgtggctggaagatgaacagtctctggaagaaaagctgaagttatttcaaaaatatgagctggcaggagtggcggaatggaaactgggactggagcgtaacagcgtatgggatttgattgagcagtaccttaagtagaaaatccgtaaaatgtaatgaaaattattttgcaaaaatagaaaggaagacagtgatatggcagaagaaatgtttaaaacaacattaatgggtggatttgataaggatgacgtacaggaaaaagtacagaagatgaaagatgaaacagctcagcagcagcttgccttcaaaaaagagattgaagaaaaagaacaaagaattgctgaactgcagaaaagactggaattaaaagaagccaatcaggaacgtctggaaagagagattcaggaaaaataccagaaatatgtagataattatgaaaccatcggaagagttgcgttggaagcacagttaagagcggacaaaatgattgaagaaacacaggaaaaatgcgacaagatggttgccgatgcagaagcggaagcaaagcagaaaattgccgatgcagagttagaaattgatggcaaactcttagatggaaagaaaaaatacctggcattacaggaagagatgagccagattgtagatttgatcaacagtgcacagaagcatttcgcagattcctatagcgaagtacataaaatcattgatgcaatgccgacttcttttgctgaaatggaaggtgtggaaagtgaacttctgccggaaacagagaaagaaggggcagaagtagaggcagaagtagaaacagaaactgagcttgaaacagaagcggaagcagagactgaagatgcagaaacagaagaaacacaggaaatcgaaccgttagatgaagaagacgaagacttggatgcactcgatgatttagatgaaaatttagatgacttggagctgactccgcttgaagaggaggaagaggaagaagaagaaaacagcgaggcattggatgaagatgaaaagattgcgcttcagatttcaaaactcttaaatcaggaagaccagtacatgatggaaaatgaagaagaataattttttagaagttctgaatcatttcgattgagaaaataaaaatcctttaaagcatatacttaacagagtatactttaaaggattttttatttatgaaaaagcatatcgcacagactgttatggcattgcttcttctggtttctgtcttttttctttcaaaagaaggggcacagctggcaaatggaacacctaaagaaagcaagggagtaattgttgtagacagcgggcatggcggaatagacccgggagtgattggacaaaatgaattaaaagaaaaagagattaatcttgcaattgcgaaaaagctggaacgtttgttaaaggcagctggatatgacgtgattatgacaaggaaaaaagacgaaggactgtatgaagaaaacagtccaaacaaaaaagtgcaggatatgcagaaaagatgtgagataattaaagaaaatcaccctcttttaacagtcagcattcatcagaacagttatccggatgaacaggtctgtggaccgcaggtgttttattatgaaagttcagcagaggggaagaagcttgcaatatgtattcaagaagcattgaatgaaaaattaaagattgatcatccaagggtagagaagtccaatcgtacttattatcttttaaaaagaagcgaggggatcttaaatattgtggaatgtggtttcttaagtaataaaaaagaagcggggctgttagtgcaggatgagtatcaagaaagagtggcgaaggcagttgaaaaaggaattttaaaatatctggaagattaaccgcttttatgatatgataaagatgtatgtgaagatagaaagagagtgtaattgtgattacaaaaatagtaaaagtagataaagaacatccggatgaagcggcaataaaagaagctggagaaatcttgaaaaacggtgggcttgtggcatttccgacagagacagtatatggtttgggtggagatggattaaatgctcgttcttcagaaaaaatatatcaggcaaaaggccgtccatcggataatccgctgattattcatattgcccaattggaagacttggataagattgcagaggatgttccggacggcgcaaaaaaactggcagaaaaatattggcccggacctcttacgatgatttttaagaaaaaagacattgttccgattgagacaacaggaggtcttgaaagtgtggcagtgcgtatgccgtctcataaggtggcaagagcgctaatatgctatggcggaaaatatgtggcagctccgagtgcaaatacttcaggacgtccaagtccaacacttgcagagcatgtaatagaggacttgaatggcaaagtagatatgattttagatggcggtgaagttggaattggtctggaatcaacgattgtagattttacagagaaaattccggttattttaagaccaggctatatcaatcagaagatgattgcagaggtaatcggagaagtgcgaatggataaagggcttttgattaccgatgcctctgtgagaccgaaagcaccgggaatgaagtatcgtcattatgccccgagagcggagttgaccattattgaaggagaaacagaagcagttgtagcggcaattaatgagaaatgccgtaaagcagaagccgaaggtcttcgcgttggtgttatcggaacagatgagacaaaaatgctttatcatgcatctgttgtaaaaagcatcggaagcagacaggatgaagaaagcatcggtctgcatttatttagaatattaagagagtttgacagtgaaaatgtcaatttgattttttcggaatcgtttgatacaccgaatatgggtcaggcaatcatgaaccgtctgttaaaggcagcgggacatcatgtaataaaagtataaaaaacaggaggaaaacttatgatagcattagggtgcgaccatgggggatttgaattaaaacaggagattattgcttacttaaaagcacgtaaaatcgagtataaagattttggatgttacgataataaatctgtggattatccggtttatgcaaaattagtaggaaaagcaattcagtctggagagtgtgaaaaaggaatcttaatctgtggaacgggaattggtatttcgattgcagcaaacaagatgaaaggaatccgtgcggcagtttgtacagactgcttctgtgctgaggcaacaagacttcataatgattctaacgtacttgcacttggaggcagagtcgtaggacctggtcttgcaatcaaaatcgtagatacttttttaaatacagaattttcaggcgaagaaagacatcagagaagaatcaaccagattgaagattaaaaattaaaaaaattgaattcaggaaaattaagacagcaggcttaaaaattttgcaaagaaaacaggagataagaaaatggcgaaaattaaaattatggaacatccgttaattcagcacaaaattggtatcatcagaagaaaagagacaagttcaaaagagtttcgtgaactggttagtgaaattgcaatgtttatggcttatgaggcaaccagagacttaaaattaacggacattgaaattgaaacacctcttcagaaaacagtagtaaaagagctggcaggaaaaaaacttgcggttgttccgattttaagagccggtcttggaatggtagaaggtatgcttgctatggttccggctgcaaaagtaggacacattggtctgtaccgtgacccggagactttaaaaccggtggaatattactgtaaacttccggcagactgtgaagaaagagaagtatttgtaacagacccgatgcttgcaaccggtggttctgcgattgctgcgattacgatgttaaaagaaaaaggagtaaataacatccgtttcctttgtctgcttgctgcaccggaaggattaaaagcactaagcgaagcacatccggatgttgatatctatgtaggtgcattagatgaatgtctcaatgaacatggttatattgtaccgggacttggcgacgcaggagaccgcattttcggtacgaaataaaaaaacacactttcgaagtttcagacacgaaaatagttacagtgaagattctgagaataaataaaggcagaggaaagtaatgacggggaagagaaaagattatatatcctgggatgagtattttatgggagttgcaaagctttccggaatgcgctccaaagacccgaattctcaggtgggagcatgtattgtaagttcagacaataaaatattatctatgggatataatggatttccaagtggatgttctgatgatgaatttccatgggaaagagaaggcgagccttacaataccaaatatctgtatgtaacgcacagtgaactcaatgcgattttaaattacagaggcggttctttggagggcgcaaaattgtatgtttccctgtttccctgtaatgaatgtgcaaaggcaatcattcaggcgggaatcaagacaattgtttatgacagcgataaatacagtgatacaccggcagtaaaagcatcgaaacgaatgttagatgcagccggagtccgttattatcaatatacacatacaggcagaaaaatcagctttgatgtttaaaagaaaatcagcaaaaattttcaaccttctatagttggtgagaaaaactgtattttctatgaaagagagagttttgagataacggctaaaaggagaaacagaaaaaatgaaaataaatgttccgaaagaagttcaagaaatcatttccgtcttgcaggaacatgggcatgatgcttatgcggtagggggctgtgtcagggacagtctccttggcagagcaccggcagactgggatattacaacatcagcaaaaccgatggaagtaaagcgcctttttcgtcgtaccgttgatactggaatccagcatggaacggtaactgttatgtttggcaaagaaggatttgaagtaacaacttaccgtattgatggagagtatgaggatggacgtcatccaaaagaagtaacttttaccggagaggtaagagaagacttacgtcgaagagactttaccattaatgcgatggcgtacaatgacaaagaaggactgcttgatttatttggagggattgatgatctgaataagaaagttattcggtgtgtgggaaatccggaagaacgttttacagaggatgcccttcggattatgcgtgccgtgcgttttgccggtcagcttggtttttcaattgaagaaaaaacaaaacaggcagcatcgaaactttcaggtaatcttgagaaaatcagtgcagaacgaatcgagacagaaatccgaaaacttttgttatcaaatcatccggaacttttaagaacagcttatgaacttggaatcacagaagtagtacttccggaatttgatgccataatgcagaccgaacaaaatacaccacatcattttaccaatgtgggagaacacacattaaaggctttggaattcattccggcaaataaggttttgcgttataccatgctgcttcatgatatggggaaaccgaaaatgaaaactaccgatgaaaatggaagagatcattttaaaggacatggggaagaaagcgagagaatcgcaaatgaagtgctgcatcggctaaaaatggataatgacacgataaagaaagtgaccaaactggtaaaatggcatgatgtgagaacccagccgacaccaaaagcagtaagaaaagccatgaataaactgggagaagaattgtatcctctgcttctacaggtacagtatgccgatacaatggcgcagagtacctatcaaagagaggaaaaactggaacggattcataaagtaaaagtaatttatgaacaaattattgaagagaaacagtgtttctctattcgtaatcttgcagtgaatggaaaagatttgattgcaattggagtaacgcagggaaaacagataggagaaatcttaaatatacttttagaagatgttttagaagaaccgtctcataatacaaaagaatatttacttgaactggcgaaaaataaaatcggacaggaagcatgatgcccatgttttctgtctgttttttggtttccgtttctttcgtattctttcttatactagtcctcaaaaaaactgcatacaataaaaagacagattaatgtatgagtgagttcttttggtttttagaaagagtcctatcgtatgtatggaaaataagggggaggaaaaaaggagtgcatgacagggggattagcattttagaaaagtatgatttagaagcatcggctgcaagcagaggtcgtggtgctttaatttgccagaccgggcaggggcttgttttaatcagagagtattacggttcaataagaaaattagaatatcaggcgaaactacttgaaaaaatttcaggtcaaaaagaaattcatgtagatacactaaaacgaaataaagaagaaaactatattacagttgataaagaaaatattccatatctggtaaagaactggtacgatggaaaagaatgtgatacacagtcccgcaaggatatcatgcgcagtgtaaaagcacttgccagcttacataaaacaatgcagatgccggtctgggagcattatgtgagggaatctcttttgagtgaatatgaacgccacaatcgggaattgagaaaaattaaaaagtttatatttcaaaaacatcagaaaaatgaatttgaacgctgttatctggaacatgcagaccgttatctttgctgtgcagaagaggcttttaagcgtatcagtcaatcttcttatgacagactgcgtaccgtaagcctggaaagaggctgtgtctgccatggagcgtttcatcagcataacattttgatgtgggattcagaaactgcggttgtcaactttgataattggaattatgatgtgcagatggcagatttgtatcagtttatgagaaagatattagagaaacacggttgggacaaagaactgggaaaagagatgattcaaagctattgcgagattcgcccgctcataaaagaagagagggaaaatcttgccgtccgatttgcttatccggaaaaattctggaaacttgcaaattattattatacgcacaataaagtctggattccgaaaaaaaatctggaaaaacttaaaaagctgatttctcagtacgaaaagtggcttgaatttgtagaaagtatcaacacattggaaaaataagagaaaaagatgtccggggctttttgaatacgcttgacaaactataggaaacaaggtataaataacagtatgttgaggttgtattttgcagccacagttagaatcaacattgtaaataagattatttattttaggaggaaatattcatgaacagaacagaattagttgcagctatggcagcagaaactcagttatcaaaaaaagatgcagaagcagctttaaaagcatttatcgatgtagtatctgctgaattaaagaaaggtgaaaaagttcagttagttggttttggtactttcgaagtagctgaaagagcagcaagagaaggaagaaatcctcagactggtgaaactatgacaatcgcagcttctaaaaatccaaaatttaaagctggtaaagcattaaaagatatggtaaacgcataaaaaatgagattagacaaatatttaaaagtctcccgtctgattaagcgcagaactgttgcaaatgaagcctgtgatgcgggacgtgttctgattaatgacaaaccggcaaaggcatctgcgcaggtaaaagcaggagatattctggaaatccagttcggaagcaagaatgttcgagtggaagtgctggatgtgcaggaaacggtgaaaaaagaagcagcaagcgagctgttccgttacctttaaaatttgtgtatattagagaaaaatcccccatataatctttttaagagagttgggggattttttattttggaagaaaaagtggtggaaagaagagcacataaactggaacttcgtgcaagaaataaggggagtataaccggagtcagtgatgtgctctgttttgatgaagaagagattcgtttggtgacagaattgggtattttaagtgtaaagggaaaagaactgcatgtgacacggcttgatttggaaaaacaagaggtagacattgcagggaaagtagacagccttatttacgaccgggcaaggggagaaagtgtgcagggaaaagaaggaatgataaagaggttttttaaataaagatgagcaaatatatggaacaggaatttttgcttcttctgaaacttttcctgacggggattttccttggtctgctttatgactgccttagaatctggcgcagtgtgatgacgaacagccgtttctggattgatttacaagatttaatttattggagtagtgcggggctttttgttttttatgttatatatatggaaaataacggtcagatacgtgtttatgcgctggctggaatggcagcaggagctcttttctattatgcgacaataagcagatggattgtgagactgtttggatttttattgttgaaaatcgtaactttatttggaatcttgctgactcctctacacaggggaagaaaaaggttgaaattatgtattaaaagagttaaactttttttgtatgaacaaaagtcgatacaaaaagtcaggaagaatcagaatgagaaagaaagaaaatcaaaaattcagtcggaaacgaagagaaaaattaaagaaagatgaaaatagacagccggaaagcaaaacggcgatgattagtgtgattttagttgcttctgcactttcgatttctttaatggcaagaagttatgcattagaagaaaaaataggtgactataaaagccagagaaaagaagtcaaggcacagatatcagcagaggagcagcgcacaaaagagattgaagcattaaaagaatatatgcagagtgatgaatatgcaaaacaggtagcaagagaaaaacttggactggtggaaggagatgaaattatttttaaagaaaagtgataattttgtctaaaattttttgaaaaccagaacatgtttttgacaaagtttaaaagaaaaaacatctataatactctttggacaggagtggctgtttagggagggatataagatgcaggaatggatgattgccatgttcatagtcagtatcctgttaatactgagggacatggcaaaaactgttttttcagatatgagaaaaagtgcggcaactgtaatttatgaagagcatccgcaaaaagagagaatgagacgttatgccgctgcatttcaaaagcttgcggatagtttttatggacttccttatcgaaaagactatatcagcaatggagagctggaagacatgattcgacagcttcgggatggtccttgcagaagttgtacggcgggaaaactctgttgggaagaacatcctttgcagacgtatcagattttatatcatctgcttcgtttgatggaaaaacaggatgtacagaaaatcatgtcggcaagagcgaatttaacagagttttgtatcaatcaggggaaaatgacggaacagatgcagaggctgatggaacgacagaagcaaatcctgatttggaataataaactgctggaaaatcggatggcggttgcagaacagttgggagagatggcacagcttatgaatacgctgtcgaatgaactctttgatattatccctgtagatgccgtgtttcaggaagagttaaaacgtcgtttaaagaaaaaacatattttggcaggaaatatctggatgttagaacagccagacgagaaaatccagtatttctgtgaattatatacgaaaggaaaacgctgtatttcggcagcagaagcaggacaggtactttcaaaaatgtgtggctgtcagatgacaccccgaatagagggcaagatgtttctgacaaaagaaaagatgaccgtgcgatttgtagaggatgtaaattttcggattttatatggagctgcaaaggtaacaaaagacagagaaacaatttccggtgataattatatgtgcacggcagaagataatggtcagttttttatgtgtctttcggatggaatgggttctggactcgaggcttgtaaagaaagcgaacatgtggtagatttattggaacagctggtggagtctggattttcaggggaaagtgcggcaaaattagtgaattctgttttaaatcttcagatgcggggcggtaaattttcaaccgttgatgtgtcaatcattgatttatatacgggaatgtgccatttcttaaaggctggtgcagcaacgacatttatcaagcgtgaccagtgggttgagagtatttcatcggagagtatggcactggggctggtatttccggcagattacgagtcactgacaaaaaagttgtataatggtgattttttaattatggtgacagatggagttttagatgcacttccggaggagcgggccgaggagactttaaaggaaattattttacagactcatgcgaaagcacctcaggaattaggaagaggaattttacagaaagtgctggcactttgtgaatataaggcagcagatgatatgactgtgctggcagcaggcgtatggaaaaaataaagattggaaaacagatgaaatgaaaaaggtatttttctatatcgaacaatatcagatgataaaaccggatgacagggtgattgtggggctttcaggaggcgtagactcagtagggcttctgcttttattaaaagaatatcagacagaatgtcaaaagaaatctccggaaaaaaattcttttttgcttgaggcagtccatgtcaatcatcagattcgaggtgaagaagcaaacagggacgaaacatttgcaaaagacttgtgtgagtcacttggtgtttcctgttcctgttattcctatccggttttagaactggcaaaaaagcaacatttaacggaagaagaagcagggcggatggtcagacatcgggcgtttgagacgcaggcgaaaaaggcgaaagagaccgttaaaatcgcacttgcacatcacagagatgatttggcggagacaatgattcataatctggtacggggaacaggaatcggtggaatggcgggaatccgtccggttacagagattaatgggatttcttatattcgtccgctcctttgtgtggaaaaagaagaaattaaagaatggctggaaaataaaaatcagctttgggtagaagacagtaccaacaaggaagcttcttatacaagaaataaaatccgtcagaatattcttccacagttgaaaggactgaatgaaaaagcagtcctgcatctggcaaatgcagcagaaacttttcttatggcagaggaatatattggcagaaatgcggatatgatgtataacagatatgtaatctgtaaaaaggacagaacaatcataaaacagggattatttcaggaagatagattaatgcagtcttatgtgattcaaagagcggtttctgagacagcaggtaaaaagaaggatatcggaatgttacatgtcaagctgatacaggagcttgaaaagaagcaaagcggaagccgaatttctctaatttatgggattacagtctggcagaattatggggatatctgtctgataaagggagaacttgaaaaaaaatcagaaatcgagctgaaaatggaagtatttccttatgaaaacatgcaaattcaggaaaaaaagtatacgaaatggtttgattatgataaaataaaagagattccgtgtgtgagaaaaagacaggcgggagatttccttaccgtaacgaaagagggaggaagaaaaaaattaaaagattatttgattgactgtaaagttccaagacaagaaagagacagtcttactgttttagcagacggttctcatattttatgggtagtaggatatcgtatcagcgaatactataaagttacggaaaagacgaaaacagtaatcagagtacatgtaaaaggagaaagcgaagatgagtgaaacaatcagagagttaatcagtgaagaagatgtggctgcaaaagtaaaagaaatcggagcacagattacaaaagattatgaaggtaaagcggttcatttaatctgcgttttaaaaggcggagtgttctttacctgtgaactggcaaaaagaattgaagtgccggtaagccttgactttatgtctgtatcgagttatggggatgatactaaatcaagtggagtggtaaagattattaaagacttagatgagagtattgaaggaaaagatgttcttattgtagaagatattattgattccggaagaacattaagctatttaatcgaagtattaaaacagagaaatccggcaagcatccgtctgtgtaccctgcttgacaagccggaaagacgagtaaaagatgtaaaagtagattatgtatgtttcaatattccggatgaatttgtagtgggatatggtctggactatgcacagaaatacagaaatcttccatttattggagtggtagaattctaagggcagtccggtgaaaggagatacacgaagtgaataagcaggcaagaagctggattccaagtattctgctgttgattgtattgtttgttggcggttactggtttatgaccagacagtttacaattaataacagttattcccagcaggatttctatgaatccgtacagaataatgaagtggaaagtgtatacatccatccgaacaaagaatacccaaccggaagagtgtcagttgatttaacaaatggaaattccgtacagttttacgctttggatgtaaaagaaatacaggattttttgggagattattcagaaattgcactggaagtcggagatgttccgggagataatattttcctgtcttctgtactgccgattattttagtggcagggatggcattttttctgattagtatgatgagcagacagatgtctggaggcggaggtggcggaaccaatgccaagatgatgaacttcggaaagagccgtgccaggatgacggtgaatgaagaaaataaggtgacatttaaagatgttgccggtttggaagaagaaaaagaagaccttgaagaagtagtcgatttcttaaagaatccacaaaagtatacaaaagtcggggcgagaatcccaaaaggtgtgattttagtcggacctccgggaaccggtaaaaccctgcttgcaaaagcagttgcgggtgaagccggagtgccgttcttctcgatttccggttcggatttcgtagagatgtttgttggtgtaggtgcatcgagagtccgtgatttatttgaagaaggcaaaaaaaatgcaccatgtattatttttatcgatgagattgatgcggtagcaagaaaacgaggcactggaatgggcggtggtcatgatgaaagagaacagactttgaaccagttattggttgaaatggatggttttggagtcaatgagggaatcattgtgatggctgcgacaaaccgtgtagatattttagaccctgccattttacgtccgggacgctttgatagaaaagttggagttggaagaccggatattaaaggtagagaggaaattttaaaagttcatgtaagaaagaaacctcttggagaggatgtcgatttacatgaaattgcaagaacaaccgccggatttaccggtgcagatttggaaaatcttatgaatgaagctgcgattttaactgccaaagatggaaggtattatctgacgcagaaagatatccgtcaggcatttgtaaaagttggaatcggtgcagaaaagaaaagtaaggttatttcagaaaaagagaagaaaattacagcatatcatgaagcggggcacgcaattttattccaccttctgccaaatatgggaccggttcacacgatttctatcattccgaccggtcttggggcagctggatatacgatgccgcttccagaggcagatgaaatgtttaatagcaaaaataaaatgcttgagaacattgtagtagacttaggaggaagagttgctgaggaacttattttcaaggatgtgacgaccggtgcttctcaggatatcaaacaggcaacacagcttgcaagggcgatggtgacacagtacggaatgtcagataaagtcggattgattaactacggaagtgatgaggacgaagtatttattggtcgtgatttggcgcatacgagaaattatggcgaacagaccgcagcagtgatagatagcgaagtaaaaagaatcattgatgaagcgtattcacaggcaaaagagctgattggttcacatatagatgtcttacacaaatgtgtggaactgctgttggaaaaggaaaaaatcggacgggaagaatttgaggcattgttttcagaaaatgaggagcaaaaaagcttagagaatgatttgggcggtactttgtatgatttaacaaaaagataagcagagtcgttttatagagcatgtaaaattattcaaaaaaagttttaaaataataataagattgtgcacactttttgtgccgtacatgctattataataactgtaaaaaccccccaatacattatatagtttttgctacaccccataagaagaaataccttctccaaaagaggcagtcgagagactgcctcttttactttacactcatttagaattataaagagtaattcaaacacagaccggaataaaaagagaggatgcaaaatatgaattacgaaaacttaaaaaatatgcaaaaaattcaggagtatgtgacgaacatgcgccctgctttcaataaacgtgcggtatttagtgatgagacggaaagttaccgtatgccatttgagccaaaagccggagacacagtaaaaatcagaattcgtacgaaacgtggaaatgttgatatggtctgtctggtcagcggacaagaaaaaaagaagatgaatctggttgagacaagagatgggtttgattattacgaaacgaaacttctggttggaacagaaaccattcattatcattttgaattattttccggtaaagtgcattgctactataaccgttttggtattgtaaaagatttagatgaacattatgcatttggaattgttccgggatttgaaactccggattgggcaaaaggtgcagtcatgtaccagatctttgtggatcgtttttgcaatggagataaatcaaatgacgttgtaaccaatgaatattcttatatttcagcaccggtacaaaaagtagaagattggaatcggccgccacaggcaatggatgttcgtgatttttatggtggagatttacagggagtatgggataagttagactatcttcaggatttaggtgtagatgtgatttatttcaatccgatttttgtctctccatccaatcataaatacgatattcaggattacgattatgtagatccgcattacggaaaaatcgtaaaagatggaggagaaccgttaaactggggtgatcaggataattctcatgcatcaaaatatattcagagagtaactgattatgaaaacctggaagcaagtaatcgtttctttgcacgatttgtagaagaagtacataaaagaggaatgaagatgattctggatggtgtctttaatcactgtggttcatttaataaatggctggacagagagcgtatttatgaaaatcaggtaggttatgaaaaaggggcttatgtatcggcagacagcccataccgcagtttctttttattccataatcaaaatgactggccgtataataaagactatgatggctggtggggacatgaaactctgccaaaactgaattatgaggcatcggacagtctgtatgaatatattatgaaagtggcaagaaaatgggtttctccgccttataatgtagatggatggaggctggatgtggcagcagatttgggacacagcaacgaatataatcataaattctggcgtgatttcagaaagaatgtaaaagaagccaatccaaatgcgattattctggcggaacattatggagatgccaagagctggttagagggtgaccagtgggatactgttatgaattatgatgcatttatggaaccggtgacttggttcctgaccggaatggaaaaacacagtgatgaatacaacgaaggcatgtacggaaacagtgactgctttatcggggcaatgaaatatcatatggcaagcttttatgctccatctttgatggtatccatgaatgagctttccaaccatgaccattccagatttcttacaagaaccaatcataaagtaggtcgtgtggctaatttaggttcccatgcagcatcagaagatattaataaagcggtattgcgagaagccgttgtcatgcagatgacctggcctggcgcaccgactgtttattatggagacgaagcaggggtatgtggatttacagacccggataaccgaagaacctatccgtggggaaatgaagataaagagttaatcgaatttcataaagaaatgattgcgattcataaagaaaatgaagaatttatcaaaggttctttaaaattccttgcaaatgattatcaattgctttgttatggaagatttacgaatacacaaagaagtgtgattgcaatcaataacagtaatgaagctaaaacaatttctctgtcggtatgggaacttggaatctcacgatccagagaaattcactttaaacagttaattgcaaccggtgatttcggttatagcctgataaagaaagtatctgtctgtaaaggcggtgtgcttcagctgaccctgccatcacatggtgcagtcgttcttcgttgtaccgaataggaaaaagtgcgttaaagcacgttaaaatacgttagaaataatgaaaataaaaatatgaattgacagacaatacagggtttgatataattattttcaataaagagaaatgctaagacgaggaggagtacatgctcaaccggttttcagagagaagatggcaggtgagaatcttcagcaagggagtatggaagtagcctctgagcagtgagacgaacgaagtggataacaggctttcagtagcgctcaacggaagtttccaacgttatatggaaaatgatatcgaaaaaatctgatttttttccgtatcagcagagtgcaggaagagattcctgaaattaggtggtaacacggattgtttattcgccctaagccagagatggtttagggcgtttttttatcccctcgtgagggcactcaagtaaatttgaattaggaggaaacgatatgaaagggacagaattgtttgtaaaggcattacaaaaagagggaattgattttctttttgcttatccaggaggatatgcgattgatatttttgatgaattatataagcaggattccattcaggtaattctgccacgtcatgaacaggggctggtacatgcagcggatggatatgcaagagcaactgggagaaccggagtctgtcttgtaacaagcggacctggagcaacaaatctggtaacaggaattgcaactgccaattatgatagtgttccgcttgtttgttttaccggtcaggtaccgacaagcttgattggaaatgatgcatttcaagaagtagatattgtagggattacaagaagtatctgtaaatatgcggtaacagtaagaaaaagagaagatcttggaagaattattaaagaggcattttatattgcaaataccggaaaaaaaggaccggttgtagtagaccttccaaaagatattatgttagaagagggcgatgacctttatccaaaagaagtaaaaatcagaagctataagccaagcaaaggtgttcatatcgggcagcttaaaaaagcaaattccctgctttcacaggcaaagaaaccattatttttaatgggtggcggagtcaatatttccggtgcaaatgaagaagcaaaaaaacttgcagagctgacacaggttccggttattacaaccattatgggaaaaggggcacttccaacaaatcatgaactgtatattggaaatgttggaatgcatggatgctatgccgcaaatcacgcaatcagtgaatgtgacctgttgttttcgattggaacacgttttaatgaccgtattaccggtaagattgatgagtttgcaaaaaatgccaaaattgttcatatcgatattgatgcggcttcgatttccagaaacattcaggttgatatcccgattgtagccgatgcaaaagaagcaatgacagcacttttaaaacatgccagaccatgtgatactaaagactggcttgaagaggttcgtggatgggaaaaagaacagccacttggtatgaggaaagataagggaatcacaccgcagaagattatcgaatgtatgaatgaagaattaaaaaaagcggttgttgtaacagatgttggacagcatcagatgtgggtaacacaatatctggaaatggatgaaaacaaaaaacttttgacttccggtggtcttggaacgatgggatatggacttccggcagcaatcggtgcaaaattcggttatccggatacccctgttatctgtgtttccggtgatggtggagtacagatgaatattcaggagcttgctaccgcaacagcttacggacttccggttattctctgtatctttaataacagttatctgggaatggttcgtcagtggcaacagttattttatggaaaacgttattcctctacctgtaccagaagaagaaaatcttgtagtgctacctgcaaaggacctggagaacagtgcccaaaatatcagccggattttgtaaaattagcagagagttatgaagcttatggaatgagaattgaaaaagaagaagatatcaaaaaagcatttgaatttgcaaaagaacatacagatgcaccgaccatacttgaatttatgattgacagcgatgagctggtacttcctatggtacaaggcggacaggcacttgactgtatgattttggactgctaaggaaaggagaaaatgattatgaaaaaaagatggatttcattatatgtggaaaatgaagtaggtgtactggcaaaaattgcaggattattttcaggaaaatcctataatttaatgagcctgacagtaggaacaacggaagattcgaccatgtcacgaatgacaatcagtgtggaaagtgatgatgccacatttgaacagataaaaaaacagctcaaccgctgtgtcgaagtaatcgaagttattgattttacaaattgtccgattcacagaaaagaagtattgtatatcaaagtgaaaaaatgtgatgaaaaaataaaaaatgaagtgcttagaattgcaggtatctttaaacttccgattgtggattatggaaaagaagaaattttgctggaatgtatgcagacagaaaccaggaatgatgaaatgattgcttatttctcacagtactttaaaaatatcgaagtagtaagaggaggaagtgtagcaatccagggagttagtattcaggataaataagattaagaaaaacagaaaataagaaaacagtgtcggtttaatacggaatggttcttgaaccggcactgttttttggtgtgaaaaatcggtacaaatttggtatagaataaaaaaatactccaaatccagtaagaatttggagtaaaaaaatgccgcagaccggaatcgaaccggtacgggtatcactacccacgggattttaagtcccgggcgtctgccagttccgccactgcggcataataaaataaataggatgggcgatggtggattcgaaccaccgaaggcgttgccagcagatttacagtctgtcccctttggccactcgggaaatcgcccatatttatttttgccatttgtcctgacaaggtattattataacagataaattagaaaaatcaagaactttttcaaaaaaattagaaaaatctttattgctgtttcgtacagaaaaataatagaatatagtgcaaaaatcaagaaattgttgtataataaaaacaacaaaaaatgaaagtacagacaataatgcaacaaattgcgggaggtgtctttatggggaaagtaattacaatcgcaagagaatttggcagtgggggaagaataattgcacaaagtctggcagaacagttgaagattggattttatgataaaaatctgattacacttgctgctgagcggaaaaatctgccggaagagagattagagcgggtcgatgaaagaagagaaaacccgtggcgctatgatatggaagatgatattgccatacagagacagttttattatgaaccactcaatgatgtattatttgaagcccagagtgaaatcatcaaagaaaaagcagaaacagaagattgtgtaattgtaggaagatgtgcggattatctgttaagaatcaaaccagattgccgttgtgtttttattacggcaccgttggaaaaacgaatccgaaccatttctgcccgcaccggattagatgcaaaggcagcaaagcaattaattaaaaaagtagacaagcagagaaaatattactatgaaaattatacggaccgaaagtggggaaaacatcatggatatgacctctgtcttgacagcagtagattgacgaaagagcaaattcttaaaatattgactacattatatgaaaccattgagtaagctgtagttacaaaattaagtgcaaaaaaattatgagaacacataaatcagagaatgtataagaaatgtataagataagattagaagcgagggtcaaaagccctcgcttcttttgagaaagtttttcattttcagaaaaaatcagcataaaaaaggaccattcaaagttgacatttcgaatggtccttttaattattattatccattggattataccttcctgatttttagatttttttgggataaaacgttaagttttcggtggtccgtacctcctgttcttgaatttttaataaattttaaggtaaatcattatgtttctggtggtctgtaccttcctttcataaaaatatgaggtattacgttatgttcttggtggtatcattcctttcgggtttgtttgcttcgttctctttgtttatgatgttattatatcaggtaaaaatcaaaatgtcaataactaaattgaaaataataaaaaaaataataattaattttaaaattgatagaaaatattgtaattatcagaaaattataaacgataattttttgcctctgtatagcaactaacatctggcagaataaagaaaagagtgctatacttcatacagaaaaaacagaatgaatcataagcagaaaggaattaaaataaaatgaatcaaattggaagaaacgatgcatgctggtgtggaagtggaagaaagtataaaaaatgccatgagaattttgaccataaactcaatcttcttcatagtcaggggcttttagtaccttctcataaattaattaagacagaagctcagattgcagaaattagaaagagtgcggagattaatgtaaaaatcttagattatgttgcagaacatattaaagagggaatttccactgctgaaattgacaaatgggtatacgacatcacaacaaaagaaggagcaattccagctccgcttggatatgaaggatttccaaagagtgtgtgcacttcgattaataatcaggtatgccatggaattccatctgaagatattattctggaagaaggcgatatcatcaatgttgatgtgtctacaattttaaatggatattattccgattcttctcgtatgttctgtatcggagatgtcggggaagagaaagcacgtctggttcgtgttgcaaaagagtgtgtggaaaaaggtcttgaacaggtaaaagcgtggggctttttaggagatatgagtcaggcagtgcatgaacatgcagtaaaaaatggctacagtgtagtaagagaaattggtggacacggagttggtctggaatttcatgaagacccatgggtcggttatattggagcggcaggaaccggaatggtaatggcaccaggactgatgtttacaattgagccaatggttaatatgggaacagatgaaatttttgtagatgaaagagatggatggaccatttatacagaagatgatatgccgtctgcacagtgggagattatggttcttgtaacggaaaacggaccggaagtcattgcgtggtaagaaaagaaagcagaaagaggaaaggaaaaaagtaaaatatgagtattgcagttgcagtgttgaaaaaaggggaaggacgtgcattaaaatcaggcggaccttgggtttacgacaatgaaatcgcaagtattatgggaaactttgaaaacggagatattgtgattgtacgtgatttcgacggctatccgcttgggagaggatttattaacaccaattcaaaaatccggatccgtatgatgacaagaaatgaaaatcaggaaattgaccgtgaatttttaaaaatgagagtacgagatgcatgggaatatcgaaagaaaacggtagatatctcaagctgtcgtgtgattttcggggaagcagattttctgcctgggatggtgattgacaagttttcagatgttcttgttgtacagtctttagcacttggaattgataagttaaaaatgataatcattgaagaattaaaatcagcaatggcagaagatggtattacaatccgtggtgtttatgagagaagcgatgcaaaagtgcggcttcaggaaggaatggaaagagtcaagggatttatcggtgaaccatttgatacgaaagtacagattgtggaaaatggtgtaaaatatattgtagatatagaagatggacaaaaaacaggttttttcttagaccagaaatataaccgtcttgccattcagagattatgtaaagatgcgaaagtcttggactgctttacgcatacaggctcttttgcgttaaatgcgggaattgccggagcaaagagtgtaaccggagtcgatgcctctcagcttgcagtagaccaagcaacagaaaacgcggagttaaatggactcgaaaagcgtgtaaaattcatttgcgaggatgtctttgagttgcttcctaagttagaagccgaaggagaaaaatatgacgtagtaattctcgaccctcctgcgtttacaaaatcaaaaaattcgattaaaaacgcagtgaaaggttatcgagagattaatttgcgaggaatgaaactggtcaaagacggcggttatcttgcaacttgttcttgttctcattttatgtcgtatgagttgtttacccagacaattggacaggcagcaagaaatgtgcataaacgtctacgtcaggtagaataccgcacacaggcagcagaccatccgattttatggtctgcagatgagtcttattacctgaaattctatatttttcaggtaattgacgaaaaatagaaaataaaatattgacaatcttttttatccatgctatgttgtaattgcttatatgactgacggaagtggaatcaaccacagggagtataagccgttgaagccgaccgtctgggcattggatgttcagaaagtgggcttttttttcgttattatatagaaaattttgttctatgaaatgaaagtcaacggatcaattaaaaatgtatgatgggaaaaaggagagacattcatgaaaatgttatcgctggaaacagaattaaaagaaaatgcttatcctggacgaggaattgtaattggaaagtccaaagatggtacaaaagcagtgactgcttattttatcatgggaagaagtgaaaacagcagaaatcgtgtgtttgtagaagatggagagggaattcgtacacaggcatttgacccgtctaaattaactgacccaagcttaattatttatgcgccggttcgtgtactgggaaataaaacaattgtgacaaatggtgaccagacagataccatttatgaaggaatggacagacagctgacttttgagcagtctttaagaagccgtgaatttgagccggatggtccaaattatacccctcgtatttccggagttatgcacattgaaaatggaaaatacaactatgcaatgtcaattttaaagagcaataatggaaatccggatgcctgcaaccgttatacctttgcttatgaaaatccggtagcaggagagggacattttattcatacttatatgcatgatggaaatccacttccaagttttgagggagaaccaaaactggtagagattccagatgacattgacgcattcacaaaaaatgtatgggaaagcctcaatcaagacaataaagtttctttatttgtacgtttcattgaccttgaaacgggagactatgagactagaattgtaaataaaaatcagtaatctaaaaatgttacggcattagagtatttttaaatctgttctaacaataaaggagaaaatgagaatgaaagaattagcattaaagtatggatgtaacccaaaccagaaaccgtccagaatttatatggcagacggaagtgagcttccaatcgaagtaatcagcggaagacctggatatatcaactttctggatgcatttaacggttttcagttagtaagagaattaaaaaaagcgaccggacttccggcggctacttcttttaaacatgtatcaccagccggtgcagcagtgggacttccgttaagtgagacccttgcaaaaatttactgggtagatgatatgggagagctttctccgcttgcctgtgcttatgcaagagcaagaggtgcagacagaatgtcttcctttggtgattttattgcactctctgatgaatgtgataaagatacagcgatgctgattaaacgagaagtttctgatggtgttatcgcaccgggattttccaaagaggcacttgaaattttagcgcagaagaaaaacggaaactataatatcattaaaatcgatgaaaattatcagccggcaccgttagagcacaaacaggtttatggtgtgacatttgaacagggaagacaggaacttccaattgatgatgaactgctttccaatatcgtgacagaaaataaagtaattccggaaaatgcagtcagagacttaaagatttccctgattacattaaaatatacgcagtccaattccgtctgctttgtaaaagacggacaggcaatcggtatcggtgcaggacagcagtctcgtgtacactgcacaagactggcaggacagaaggcagataactggtggttaagacagtgcccgaaagtcatgaatcttccatttattgatggaatccgtcgtgcagacagagataatgccattgatgtttacattggagaggaatatatggatgttcttgaagatggtgcatggcagagaatcttcaaggaaaaaccggaagtctttacaagagaagagaaacgtgcatggttagataaactgaccgatgttactcttggttctgatgcattcttcccattctcagataatattgagcgtgcacataagagtggtgtaaaatatattgcagagccaggcggttctgtaagagatgatgcagtaatcgaatgttgtaataaatatgatatggcaatggcatttacaggcatccgtctgttccatcactaaaattacaaaaattatttttaaaagaggcggcagtgagaattttcttactgctgctttttgctgttctaaaaaagtgaaattttagttgaagacaaaaatagaatttgctatactgtatacgacgtaacgggattgtggttggacagaccgctgcgaaataaatttacaggagaggtttaataaaatgagtataagaattggtatcttaggttatggtaaccttggaagaggcgtagaatgtgcaatcaaacagaatgcagacatggaattaaaagcagtatttacccgtcgtaatcctgcggatgtacacattcttaccgagacagcaaaagtatattctgtagatgaagcagtaaaaatgaaagatgaaatcgatgtattgattctctgcggaggaagtgcaaccgatttaccggtacagactccagaatatgcacagtactttaacgtagttgacagctttgatacacatgcaaaaattccggaacattttgcagaggtagatgcagcagcgaaaaagagcggaaaaatcggcttaatttcagtgggctgggacccgggaatgttctctttaaatcgtttatatgcaaatgcaattcttccggaagggaatgactatacattctggggtaaaggtgtaagccagggtcattccgatgccgttcgtagaattgacggcgtaattgatgcaagacagtatactattccggtagagaaggcgttaaacgctgtaagaaatggtgaaaatccggtacttgcaacaggcgaaaaacatacaagagaagtttttgttgtagctgaagaaggtgcagataaagatagaattacaaatgaaatcaaaacaatgccgaattattttgatgaatatgaaacaacggtacatttcatcagcgcagaagaaatgaaagcaaatcatgcaggacttcctcatggtggatttgtaatccgcagcggtcagacaggatgggaaaaagaacatcatcatgtcatcgaatacagcttaaaactggattctaatccggaatttacatcttctgttattgtggcttatgcaagagcagcttaccgattaaatcaggaaggacagagcggatgcaagactgtatttgatattgcaccggcatatttaagtacaaaaacaccagaagaacttcgcaaacatatgctttaataagcagattgggagaggatatcagtgaattttgatttaaaaacggaagtaaaacgaatgggtctgggcttgatcagtgcactgattatggcagtgaatattaaaacactggtaagagcaggggggttgtatccaggtggctttaacggaattacccttttgatacagacaatctgcgaacgatttttgaatctgcagattccatttacagcagtcagcctgttgttgaatgcaattcctgttattatttgttttcgggcaattggcaagaagtttacaagtacttcagctttgattgttattgtaaccagtgtgcttacagacttagttccttatcatccaattacagatgatattctgctgatttctgtgtttggcggtattatcaatggatttgcaatcagtttgtgcctgattggaggcgcaagtgccggaggcacggactttattggaatttattttgcagaaaagaaaaataaagacgtatggaattttattttacttggaaatgcctgtgtgttgaccattgccggagttttatttggctgggataaagcactttattccattattttccagtttgcttctacgcagatgatacatatgcttcatactgcctacaagaaagaaactctctttattgttacggatcgtccggatgatgtttataaagaaatttatgaagtgacaaaccacagtgcaacagagtttgcggcaacaggctgttattctaataaacagagaaagatgttgtattctgttgtatcttcttcggaggcaaaagttttagtcagtcgcgtacagaaggcagacccggaggcatttatcaatgtgattaaaacggattttctggaaggacatttttatcaaaaagttgactattaatcggattagtttggtacaaacattgggtgtgtcacagtttgttccgtaaaaattaagtaaaaggactattacaaaaatgtgaattttttgtgatagtcctttgtttttttaccattttgtggtacagtaataagtggagtagagcgattaaaaatcgtgaaaaataaacgaaaagagaagtcgaaagttgtttcgacgagaattaaggcagcttattgtaagacagagggaaaatacagagagtattacaagcagcaggaggaactaaatgaaaataaaagaagtaaaaaaactgctggcaatcgctgtgagtgtttctatgcttacaccgtcaggtgtatttgcatcagaagcttccagtacagaggcagcagtaacggctgaacagacaacaggggaaacgagtgtgacagagccggagcagtcatcaggagaggtttctgaaccggaacagccatctgaaccagaacagccgtctgaaccggaacagccatctgagccggaccagccgtcgaatccagacaaaccagaaaatccggatcagccgtcaaacccagataaaccagaaaatccggaccagccgtcaaacccggataaaccagaaaatccggatcagccgtcgaacccggataaaccagaaaatccagaccagccgtcaaatccggacactccggaaaatccagataaaccagcccagggtatgactccggagcaatatgaggcatcaaccggatataaacttccggatggttatgcttacgtgctggatgcaaatggatatgtcattatcgaaaatggtgcaccaaagcttgcgaaaaaagcagaagataatacaaaaaaagacgataacaataatcagaataataacaataacaatagtaatagcaataacaatagcaataacaatagtaatagtaataacaatagcaatagcaattcttctaatgataacagcagtgataccaagaaagatacggagaaaaaagaagatacaaccgcagcaaacagtggaagtggttcaaattcccagttaattgcaaatcagcagatttattcttctctgcctacaatggtggatgatttccgtttctggacagttgcaaagaaatatgcctttgcaaaagaagaactgtcaatcgtagaagaaatgaaggatggagcaaaagaagtaggtaaactgtcaaaagatggtgtctgctatattcttcaggaagaaaacgatggatggctttttgtagagtcaggtgatgtacgtggttttgtaaaaacagagcaggtgattttaggcgatgaagcagaccagattgtacagaaactgacggaagaggcaaaaaaagaagcaaaagaacagaaaaagacatacaaaggaattgcaaaactgttgacagaagcaacaccgagcgttccggaatccgaaaatggagcatttttccatactcgttctacggtaaaacagaccgttgtggataaagtgtatgcactttgtaatgcagattttgtagcaattcatgaagataaaaatacggagagtcgtgctgtcggaacgttaaacaaagacaatatctgttatattttagcagacgaaaatgcggagtttgtttatgtggaatccggagatgtcagaggatttgtagaaaataaattccttgatacggacaagaaagaaaagaaaaaagcagaaaaaagtttgttaacacaggcaacagccgcagcttctgctcttaagaatacaaaagaggtcatcagtctgttccctacaacaaaaacggctgctgaccagaatgatgatattgataacattatcagtaataaaatttctgcaaccggagaagaccagtttgtgaccgcacaggaagtcgtaaaaccggcagaaaatgcagcctgctattatactttgacttctgtaaaatctggtgttccaaacggggaactgagaacttcgattgttcagtttgcaagtcagtttattggaaatccttacgtatggggtggaacaagcttaacaaacggtgcagactgttctggatttgtacagagcatttatgctcagtatggttatacactgccgcgagttgcagaagatcaggctcagtatggtacaaagattccagtagaagaagcgcagccgggtgacttgattttctatgcaagaaatagttatatctaccatgttgttatgtacgcaggaaatggagaaaccgttgaagcacagagttcaagaactggtattgttcatggaacggtcaatacgaacaatgcagtatgggctgttcgtattctcgaagacactccgtctacagtaagtggaatttatggaagtgatatttctgaagtaaatgcaacacttctgcagtatggtcagtctcttggtacatttaaaattacacattattgtggtggttcctgctgtaatgatgaatgggcaggtgtaactgcgacaggcgctccgttagtagagggagataccattgcagttgacccgactgtcattccttatggaacaaaagtcattatcaatggtcatatctttacagcaacagactgtggtggagcaatcaaaggaaatcgtatcgatgtatttgtaaatgaccataatcgtgcaaatcagcttggcgtttactatactgatgtgtatgttttaaaataaaaattacataaaaatgataaaattcgccacctgcataggtggcgaattgatttgtaaaaagaggaaggagcgtatcgtatgatttatacaagtcatttattagaagatacgcagatgcaggaagtggttcgtgaatgtgcgactggtatagagagtattgaattttcaattgctgaaaatctggatcgtttggaagaaaaaatcagcagttatcgagaacgactctggagaatgggatggccgcatttgtcccttcacggtccgtttctggatttgaatccgatgacgtatgattctttgattttagaggcgacaaaaaaacgctatgagcaagtctacgaagcaggaagacgtctggaagcagaaaaaattgtttttcatacctgccatttaccggatgcctatctgttgattggctgggcagagcgtgtggcagatttttttaaacggtttttagatgggaaagatggaatcatgattgtaatggaaaacgtatttgaccggattccggaaccgatggtggaagttgtagaacgggtagaccgtccggatttcagactctgtctggatattggacatgcacattgttattcggatatttctgtcctggactgggcaaaaagctttggcagttacgtcagtcatgtccatgttcatgacaatatgggtgacagagacagtcatattgcacttggagaaggaacaattccttatgaagaagtgctgggattattaaaacagaataatccacagatggattgtacgattgagtgtagtagtcttgaaaaggtaaagaaatcttatgcctgtctgaaacagttaaaagaaaatggtatcttatgaaaaataaaaaagggcacattctggcgaaaaccaggatgtgccctttgtaaatatgactgcggcttggctgatttgtactgtcaggcttatccttgatggttaaaacagtaggtgcacattttgcatggacttaagccgatagaggcagttaggtcatctaaacgatgatagtgcagagttgtgaagtttaactgttttccgatttcctctaacatttctttatagtttgtagagtctggatcggcataatcagcaagtactttatctgaaacgttgtctccttcacgctttgcgatgatacggcgggtaattagatccatctcagatttggaacgtgagaagtttaagtacggacaaccgaataaaagcggaggacaagccggacggatatgtacttcttttgcaccgctgttatataaaaattctgtagtctcacgaagctgtgttccgcggacaatggagtcgtcaattaagagcagactcttatttttgattaaggcttcgacaggaattaatttcatacgtgcaatcagatttctttggctctgatgtgtcggcatgaaagaacgaggccaggttggtgtatacttaataaatggacgagaaaatggaattccagactcatttgcataaccgattgcatgtgcagtaccggaatccggtacaccggcaactaaatcaggtttcacatggtctcttccggcatcatgctgagccagttttttaccacattcatatcgcatttcttcgacattgattccttcataagtagaagttggataaccgtagtaaacccagagaaaagaacagattttcatttcatttccaggttttacaagagtttcacagccctcagcagtcagaaaagcaatttctccaggaccgagttcgcgttcggtttcgtatccgagatttaagtaagcaaaactttcaaatgatgcacaataagcatctgattttttaccgataacaatcggagtacgaccaagtttgtctcgggctgcaaaaattccttttggagttaatacgaaaagagtcatagaaccatctatcatttcctgggcatactgaattccctctacgatagacgatttctggttgataagagaagcaaccatttcagtcgggttgatacttccgccgctcatctcaagaaaatgtgtgcatccgtttttgaaagaaagattgacaagttcctccatattgttgatttttcctaccgttgtgatagcgaaacttcccagatgtgactgtaccagaagaggttgtggttctgtgtcggaaatacatccgattccaagccggccttcaagttcatctaaatctccatcaaatttggtacgaaacggtgtgttctcgatgttgtgaattgaacgcgcaaagccgttttcaccatacactgccataccacctctgcgtgttccaagatgagagtgatagtcagttccgaaaaataaatccagtgtacaactggatttagaagctactccaaagattccacccattgtttttctcctttttcttcagaattctttttttatagtacgtggaatattatatactcttttttaaggattcgtaaagatatttttgaaaaaatggtgtataatgaagcgaagagttaaaaaatagcgtgaaaggggactgtttatgaaatttatttcctggaatgtaaacggcttaagagcctgtgtacaaaaggggtttatcgaatattttaatgaaatggatgctgattttttctgtgttcaggaaacgaaattacaggaaggtcagatcgactttgcaccggaaggatatcatgcatactggaattatgcggtaaagaaaggctattcaggaactgccatttttgcaaagaaagagccgattgcggtgacttatggtcttggtattgagcagcacgatcaagagggcagggtgattacccttgagtatgaagatttttatgtcattacctgttatacgccaaattcacagaccgaattggcaagattagagtatcgcatgaaatgggaagatgatttccgtgagtatttaattggactggataaaaagaaacaggttattttctgtggggacttaaatgtggcgcaccgtgagattgacttgaaaaatccaaagacaaataagcataatccaggatttaccgaagaagagagaggaaaattcaccaaactgttagaggcaggatttacggatactttccgatatttttatccggaagaaacgggaatctattcttggtggtcttatcgttttaaggcacgtgataaaaacatcggatggagaattgactatttttgtgtctcaaaccgtttagaagaaaaactgatttctgcaaaaattcatacagaggtactgggttctgaccattgcccggtagaagttcagattaatttataagaaaatgcactctcggagtctttcatgcacttgcacaaaaagattccgagagtacatgaaaatcaaaaagaggtacagagtttaatgaaagaaagtgtaaaattgacgcagtttgcaaaaagtgctggctgtgcggcaaaaattggaccgaaagtgttggctgagattgttggaggacttccgaaatttttcgatgaacatcttttagtcggaacagagacaaatgatgacggcgcagtgtatcagatttcagatgaactggcactgattcagacacttgattttttccctcctgtggtagatgagccttctctttttggagagattgcggctgcaaatgcattgagtgatatttatgcgatgggcggaataccaaaaattgcattaaatattgtggcgtttccaaactgcctgggtcaggaagtgttaggtgaaattcttcaaggtggtgcgaagaaagtgcaggaagcaggggcagtgcttgccggcggacattccattaacgatgaagagccaaaatacggtttgagtgttacaggctttgtcaacccaaagaaaatgtggaaaaattcaggtgcagagccaggggatgctttgattcttaccaaaccaatcggaacagggctggtcaatacggctgcaaaagctgatatggtatcagaaacatcaagaaaacttgcaattggacaaatgagatgtttaaattattatgcatcagaaattttaaaagattatgaagtacatggatgtacagatgtgacaggtttttctcttgccggacatgcacttgagatggcggaagggagtcaggtaaccattaaaattgataccaaaaaaattccatttttaccggatgtggaagagtatgccaaaatgggtctggtaccagagggaacgtatcgaaataaagaattcttaagagaaaaaatcaaattaaatgatacaataaaagaaagttttgaagatttgttgtttgacccgcagacttcagggggacttttagtcagcctgaaaaagaaagatgccaaagaagttttgaaaagacttcaggaacaggaacagacacgctacagcaaaattgtcggtgaagtagaagaaaaacaggaagtacatttaatatttttgtagaacaaataactctctttggtgcaaagtaagccgaataaagactcagagagtacacgcagatagtaaggagtaagagaaatgatttatctggataacagtgccacgacacttaaaaaaccggattgcgtaaaagaggcggtctgggatgcaatggagcagatgggaaacagcggaagaggcggatatcagactgcattatcggcatcaagaatgatttatcaggcaagaatggcagtttccgaattttttgacttgaatcatccatccggtgtggcatttacctccaatgcaacagaagcactgaatactgttattcagggattattttcaaagggggatcatgtgattaccactgtgctggaacataattccgtcttgcgtccgctttatatggagcaggaaagaggtgtggaactcagcataatcggtgcagatgaacaggcagatgtgttatatgagaaactggaatctgcaatcaagtgtaatacaaaggctgtgatttgtacgcatggctcaaatgtaacaggcaatctggttgatattaagcggattggagcagtttgcagggcacatcaattattatttattgtggatgcctctcaaagcgcaggctgtattccaatttccatgaaagaaaaccagattgatattctttgttttaccggacataaaggacttatgggaccacagggcacaggaggaatctgtattcgtccacagatttccatccggccgttaaagagtggaggaacaggcgtcctgtcgtttttaaaggaacagccacaggaattgcccgagcatctggaagccggaacattaaacggacatggaattgcagggcttttagcggcaattggatggctgaaccgaaccacggtggaagcagttcagaaaaaagaagagaaactgttaaggttattttatgaaaatgcaaaagaaattccgaagattcatttttatggcagacctccagaagagggggtaccgcatctacctgtgcttgctttaaatttgggaaatttggattctgcttatgtcagtgatattctcgcagaagaatatgaaatttacacgagagcaggagcacattgtgcacctttgatgcatcaggcgttgaaaaccgaaaaacaaggctgtgtgcgtttttctttttcctggtttaataccgaagaagaaattaagacagcggtaaacgccttaaaagagctgtcaagaggataaggcagaaatatccggtaaaagaaaggattttataagttatgaaaaaatacaggtcactggcaggaatgatattaggcttcctgctgcttgcctggatgtcaaagacgtgttatgcagagattgccgatgtaacagcatttgaaaatctggaatggaaaaaagtgcatgaagaagcgttgattgcacctcaaggtgttgttcagtcaatctgtgcaacaaaaaattatattatctgtattgaaaatacgaacgatgctcaggatacacctgacaccgtgtctgcttattataagaatgacacggatgcagatggaaatccggttgaacagtattcgcttgcgttaagaaatacggataataactgggaacatggaaatggaatggcctataatcaggcaaaagaagagatttatgttgctccttatacaagccagaatccggagaatcggggctgtctttttgtgatggatgccaatacactggcatataagggaaagattaaaatcagcgatgattataatatacttggaattggttatcgagaagaaacggatcaatatgtaatacagacgaacgtagaaggtggatatagttttaagattttagataatcagtttcagatagcagaggatcttgggagatatgagggaacttctgttggaacgaattttcaggatttacagttagtagatgaatatattctaaatttcccattgactttgaatatgggaattggagattatttaaacgtatattctcttgagacaaaagaattagtaagctgttctaaattgaattttccgtttgaaggtgtttccaatgatgagccagagggcttatgtgaaacggcagagggaacatatattgcagtcgtagatgaagatagaacagatggcaggcggatgttctgtttttatgaaacgcaagtgccctgcaaagaagaagcagtttcggcagaagaaaacatagatacaaacgaaaatgatgtaagggaatcaaaccgacagacaaaagcagatacactgagagaacggacagattcagaaaaaaataccgattcagaagaaataccgacgtcatctgaagattataaaaaagaagcatcaaagtctttaaaaaaacaaagcgcaaaaaatacaccgaaagaagtttcatttgcggaaaaaatgagcattggtttttctgggatgattacgcaggctcaagagttatcaaaaaaactgccttctgtagtgaaacttgcgaaagaagcgggaaatctggcaggggctttcatagaaactttattaacaaaaataaaaacattgtggaagtcaggttcaacaattctggcacagaatcagagaaaagtacttttatttcttgcaataggatttacaattataagcattatgggactctgggtctgtattgtccggctgattcgaatccgaaagcagaaaaaagcaagagcggaattagagcggcttagaaaagcatggaaagaagaggcagaacagtggcttcaggcagaaagaaagcgtctttgatgaaagaaagacgctttttagcattttaaccaaatcaaggaagtcccctgcttcaattgcaaaaagcaataagcaggggacttccttgtatcaggagggggtaagccccttctgataagctgcgcagcagctatttggttatgagcaagtagcgaaagcggattgcgaatatccgcttaacaatttaaaaagcggatttattttatttattatcccattcatcttttctaaaagaaacagaatcgtcggtcatagaatcaacaattgcgagggattctacacggatgccctgttcgcgaagagaatctccgccattctggaagcctttttcgattacgataccagcaccttctaagacagcaccagattcttttacgatttccattaatccctgtaatgcacatccatttgcaaggaaatcgtcaatgattaagacatgatcctcagtgcttaagaattttttggaaagaatcacgtcatatactcttttatgagtaaaagactgtacttttgtgcagtacatttctccatctaagtttaagctttgtgctttttttgcaaaaacaaccggaacattgaaatgctgtgcaacaagacaggcgattccaataccggaagcctcgattgtaagtattttagtaattggtgcatctgcaaatctgcgtttaaattcttttcctaattcattgataaatgggatatccatctgatgattcaggaaactatctactttaagaatatttccgggttttacgataccgtctttacgaatacgttcttctagtaactgcatgataaaaatcctccttaaatcttatacaacataatacgctattttatttgctttggcaaattgtttttcaaaatgttttgaaaaaaataataaaatttatataaaacgaaagaaaagaggagaaatcatgctataatagaaatattattgtgtagaaatttgagaggtttaaaacggttaagtgctatgaaagaatatgaagttattcatgaaatttttaatcagtgtccgggaaataagacaagagatcagtttattgaagaaattgaaattgaagagacaccggaagaatgggtcagaaaaaaattcaaaaatgagaaagaattccgacttgaaagagtagaaaaagaggatggaactttagtgattgatgtgatgactgccatgattcatcagcgatatacaatttccgaaatctagcagattccaaagtgttgtttttttacgggagtttggtataattagaaaagtggtgagaggagtattattatattatggaagaaaaaaaacaggttcacagtcatacccatactcacacattagaggatggaacggtggtaacacattcccacacccacagtcatacgcatacaaaggcagtgttaaaccggctttcacgtgcaatcggacatttggagtctattcgtcgtatggtagaagaaggcagggattgttccgaagtattgattcagctttcggcggtgaaggcagcaatcaacaataccggaaaagtcattcttcaggaccatattgaacattgtattgtggacgcggtggaaagtggagataaggaagctttagatgaattgaataaagcaattgaccgattcattaagtgacagagcaagaaataagtaaaggaaggaaagcgttatgagcgaaaacaaacagtgcagcagttcaagctgtgacaagaaaagctgtgagggatgcagcagtgcaaagaaaaataccatcccgaaagaggaattaaatgcatactctgcaattaaaaaagtagtcggagtagtcagtggaaagggtggagttggaaaatcttttgtaactgcgtctctggcaaatgaaatggcagcaaaaggataccgtgtaggtattttagatgcagatattacaggtccgtctatcccaagaatgtatggtttgaaaggtgcagcaatggcagatgacaatggaatttatccgatgctgacagaaaatgatattaaaattatgtctattaacttactgcttccgcaggaagattcaccggttatctggagaggaccggtcattgcaaatatggtaaaacagttctggaccgatgttgtctggggtgaactggattatttatttgtagatatgccgccgggaacaggagatgttccgttgactgtattccagtcacttccaattgatggaatcgtaattgtatcttctcctcaggatttggtacagatgattgtaaagaaagcttacaatatggctgaaatgatgaaaattcctgttgttggtctggtagaaaactacagctttgtaaaatgtccggactgtggaaaatcgatttatgtgtttggagagagcaaagcagatgaaatcggagcagagttaaacattccggtaatggcaaaaatgccgttagacccgaattttgcatctatggtggatgcaggaaaatttgcagaagtcagaaacgaatatctttctgatgcggtcaaatgtctgcctagagcgtaaaaataataagaaagtttggttagttaataagaaaatttaagtaaagagattgcaaaatagaaaaaaatgaataattggtataaccaaaaaataaaacagcaaaatgaaattaactaaaatacgaagcaaaacattacaattcttgaacaaaataacgaagaaagaacggagtttgattgagtttgaaaaaaaatgaagattgacaaatcgaaagaatactgtcataatacgtctaacaatcaaacaaggttgtgtgaaacaaagaacatttttttaaaattctaagaagaggtgacaacgatgacagagcgtcagattaaactttcccaaacagaagacgtaaaaaattttgtcagagcagccagtaaatgtaatttcgatattgatgttttttataatagaattgttgtggatgcgaaatcaattttaggcgtgttcagtttggatttaaaccgtacactgactgtaagatgtaatggcagtgatgacaaatttaatcaggtcttggaccagtttgcaatcgcataatcaaaagaatcaaagaagagaatcccttgcctgaaatcggataagggattcttttttcttgacctgtaagaaatacaaacgtataataaagaacagaaaacaggttttagagaggagactttaagatgaaagtagttagcacagaaaaagcaccagcagcaatcggaccatattcacaggcaatggttttaaacggagtggtatatacttccggacagattgcaattgacccggcagttggagatgttactgcaacaacaattgaaggacagtcagaacaggttatgaaaaaccttggtgaagtattgaaagcagcaggaagcagttatgagaaagcagtaaagacaacctgttttttagcagatatgggagacttcgcagcgtttaacgaaatctacggaaaatactttacaggaaaaccggcacgctcctgtgtagctgtaaaaacacttccaaaaaatgtactttgtgaagtagaagttattgcagaagtttaaaaaattaatttactaactaaaaaagaatatttgaacgcagataagcattcccccgcttcaagtgcgcggagcactaagcgacgggtgaggggggatgcttctgtcagtgggagttgaaagctcccactgacagatcgcaaagcgactgcgttcatgagcaagtagcgaagcggattgcgaatgttcgctttacaaaaagtgtaagagtgttcccttaaaaaagtttgggaatactctttttttatcccccctcggggcttgtgaagtaccaaatactttggtaaagtaaagtctcagaataataatgatgtatcaggaggtatgtatatcattaggaaagaggcgaggatttactatggcagaattattaaatcagatagaagagtactggagtaccagagtagagggatattcagaagtcaatgaaaaagagataaacggaacacagaaagagaattggcttcgggtgcttgaggaacgttttccggataaagcaaaagcagatttaaaaattttagatgtcggaaccggtcctggattttttccgaggattctttcagaagccggatattatgtgacagctgttgactacactgaggatatgttagagaaagcaaaagaaaatacaaaagaatatcaaagccagattgaattttatcgaatggatgcacagaatctggaatttgagaacaatcagttcgatgtagtgatttcaagaaatctgacctggaatctggaaaatccggtacaggcttacaaagaatggtttcgggtattaaaaacaggaggaatcattttaaatttcgatgcaaactggtatggctatctctatgatgaagaaaagagaatggcgtatgaaaaagatagggaaaatgtagagagaagtcagttagatgaccattatctttgtacagacattgaccgaatggaagaaattgcaaagaaagttccgctttctgcaaagaatcgtccaggctgggatgtggaagtcttaaaagaaattggttttgcagaaattcggacagatgaaagtatctggcagagcgtgtggagcgaagaagaacggttaaattatgcctcaacaccaatgtttttagtttcaggacagaaaggggaaaactagtttggaagcacagaagaattttaaaattggaacacttgaagtaaagccgggagaagcttatcatggaaagctggaactttcaaagggagcatttgaagtgccggtgtctgttttttgcggaaaacgaccgggacagacggtgttaattacagcgggagttcaggcaggggaatatgtaggaatccagtcagcgattgatttagcaagacatttacagatagagaaagtaaacggtacaatcattattgtgaaggtaatcagaaaagaagagtttgaacatcgtgccggaagtctgggagtcaaggatggaaagaatttaaatcgtgaatttccaggcaaggcagatggaacagagacagaacgtcttgcttatgcagtagcaacagagctgtttccttatgttgacaggtacattgatttacatagtggaaatgattatgagagattaactccttttgtttattatgcaggttgtgcaaaagaagaggttgtggcaatgtcgagaaagatggcagaacaggtcgatgtgccttatatggtacgttctgcggttgcaacaggtggtgcttataattatgctgcaagtatgggaattccaagtattttaattgagcgcggagaaatgggtgcatggacgttagaagaagcccgttctacaagaagagatgtaaaaaatattctttgtgcaattggaagctatgaggaaaaacgagattatcgacagtattatccgctggaggtagtagatgtgacttatcaggcagcagaatttacaggatgctggtatccgtttaaaaatccaggagatatgattgtaagaggagaagtgattggagaaatccgtgattatgaaggcaatcctttggaagtctgccgtgcggaatacgatggagtaattttatttgagacgggttctttgcaggtaaaagcaggaggttcagcaattacttatggacgaattgcgagaatatttgatgatagaaaagagcggattaccaagtattgggccaaacgaagcgagagctttttagagcaaagaagagcagagttgaaaagtgcactcgcagagcgatggataaaggaaattaagaaacagcttccggatggtaaaaaattaaaaatcttagatgtgggctgtggctctgggttcttctcaattttacttgccaaagagggtcatcaggtggttgggacagatttgacaccggagatggtagtaaatgcaaagaaacttgcgaaggaagaacaagtggaaccgacatttcttgtgatggatgcagaaaaattagaatttgaggatgcttcttttgacatgattatttcaaggaatctgacctggacgcttccacatgcagaagaagcctatcaggaatggaaacgtgttttaaagccgggtggaattttattaaattttgatgcgaattatggaaatgatgattgctcagatacttcagggcttcctaaaaatcatgcacattatacagtgggtgatgaattgctacaggaatgtgaagagataaaaaaacagcttccgattagttcttatgctcgtccggcatgggatttaaacgtacttggaaaggcaggattttctaagtttggaattgatttagaaatcagtagtagaatttatattgaaaaagatgaattttataatccaactccgttgtttatgttgtgttccaggaaaaaaatttgaacttaaaatgaatcaccttatgaaaaattggaatatcttgatatccccccagggggcttagagaaagattgagaaattgatatacttaatcttatacttgtaagatgaggtgataaagtgaaaaaatatgtattaaaaagattattacagttaatccccattttattggggattacttttttgtcttttgcgatgatgcgtgtcgccggttcggatgctgtaacagagctttatacgaatcgtgggacagaagtctctcaggagataattgatgcaagaagagcagaacttggactggataaaccatttctgatacagtattttagctggcttggaggaatgttgaccggagatatgggacaaagttatgtcagtggtgcagatgtgttttctacatttctttcaaaactcccggcgactttgcttttgacaggattatcaattgctttgacagttattatctcaattcctctggggattttttcagcaatgaaacaggataggattcctgatttattgcttcggttttgtagttttattggaaatgcattgccgaatttttttgttgcaatgcttttcatgcagttattcagtattaaattaaaactgctgccggttatttcagacggggtgaatctaaaaagtgcgctgctgccggctttgactctggcagtttccatgtcggcaaagtatatgcgtcaggtgcgagcaacggtacttgaggaatggaataaagattatgtgcaaggagcaatggcaagagggataagaaagaagattatcctttggaagaatgtgatgaaatcttctatgttaacgattgtcacacttttagcactctcaataggaagccttttaggcggaacggcaatcattgaaagtatttttatgtgggatggagttggaaaactggcagtggatgcaattacgatgcgagattatccatttatacaggcttatgtagtctggatggcagttatttatgttctggttaatttgattacagaccttatgtaccatcagcttgacccaagaattcgtttgggggtgacaagagaatgaaagagccgacagtaagaatgcagaagatacatagaaaccatttgaagttacgcttaatcatatttggaggtttggcactggctttagtcattgcttcgtatttcagtgaatcattatgcccttatgacccgtatttacaggatttgggcaatgcaaaagcaattccgtcagcagcgcatttatttggtacggaccggtatggaagggatatgctttcccgtgttattgtggggagtaagaccagtatttattctactttattattggtaggatttattatggtgtttggcacaatgattggaatcttctgtgcatggagcggaaaaaaaatagattctgttttgatgcgtatttcagatatttttctggcttttccgggtctggtgtttgctttggctgtggcagcagcgcttggcggtggagttcacaatgcgattattgcacttgcggccatcagctggccaaagtatgcgcgtgttgcaaggagtcagacgctggcacaaaaagaaacagtttatataaaagctgccaggttatcgggatgtgggactggaaaaataattttaaagcatattcttccgaacatctttggtccgattctggttacggcagtattagatatcggtacgatgatgatggaactggcaggtctttcctttttggggcttggagcaaagccgccgattgcagaatggggaagcatgatgagtgatacaagaaaccttttaacgactcatccatgggtaacactggctcccggttttgcaatctttgtatcggttgtgatttttaacttacttggggatacggtacgagactggttagaccctcgaaatgggaggtagaaaagaatgtcggaaatcattcgatatgaacatgtagatatcagctacaaaggagaacttgcagtacatgatgtgagcttttcagtggaagaaggagagattcttggaattgtaggagaaagcggtagtggaaagtccactttgataaaagctgcgatgggtttgcttggaaaagacggactggtgacaagaggagatatctggtatcagggtctcaacctgccagatttaaagccaaaagaaatgagaaaaatctgcggtcctgaaattgggatgatttttcagatggcgggcagttctttttgtccaattcgtacggttcgggcacagctttatgaaagtgtaagagagcatgaaaagctgacaaaggcagaatttgaagtacaggtgacagagttatttgaaaaatttggatttgatgacccgaaacgaatcttggacagttatccgtttgaactttcaggagggatgcagcaaagagttggaattgtagcggcaatgttgttaaatccgaagattctgatggcagatgaaccaacctctgcgcttgatgtatcggtacaaaagcaggtagttgatgagatgtgcatggtacgtgaaaagtttggaacaacgattttactggtgacgcataaccttggagtaattcgagcaatggctgataaggtactggtacttgaaaacggagaagtaagagagtatggaaaaaccaaagaagttttggaaaatccacaatcggaatatacaaaaaaattgttgtcagcagtattagaacttcggaggtaaaagcagggtggattgtattttaaaagtagaacatttgacgaaaacgtttgtctctcagggcagagatgattacacggctgttgatgaggtgagcttttctatgaattatggagagaagctcgcgattataggagaaagtggaagtggaaagacaacaatcgtaaatatgataaccagattgttggatgtaacctctggaaccgtttatctggatggagaagagattacaaatttaagtggtaaaaaattaaagccagtttataaaaaaatgcagatggtgtttcagactccgacagaaagctttgacccgagacagactcttggagatggagtggcagagagcttaatcaatcatggcatgaaaagaaaagaagccataaaagaggcagaaaatttgctggagttatgcggattaaaaaaagaatttgcaaagcgatatccgcatgaagtcagtggaggacagtgtcagagagcagccattgcgcgggcaattgcgattaaacctaaattgcttattttagatgaagcgacttctgcacttgacgtaactgtccagaaagaaatcctggagttattggaacggttaagagaagagcgtaagatgtcctatctttttatctgccatgatattgcactggttcaaaacttctgcgacagagtgcttgtgatgcatcagggcaaaataatagaagaaggaagttcagatgaagtaatccgtcacccgaaagaagcttataccagaaggctgatagagagcgttctgtaagatataagaaaaataaacaaaaggaaagggaaaaggaatgaacaaatcgaaaaaaataattggaatggcattaagtgcatgtttgtgtgttagtatgcttgccggatgtggaagtaataataaaacagaaacatcaaaaagtgattcaaaaacagaaaattcagaaacaaaaaaaacaatggtaattggagataccacattcaacagttccaatgaagagaacagtacaaatccacatgacgcatattccggatgggcatgcatccgttatggaattggggagactcttgtaaaatattccgataatatggagattcagccatggcttgcgaaagaatgggaaaatgtagatgagctgacctggaagattacacttcaggacaatgtaaagttttcaagcggacgagatatggatgcagaggcagtgaaacagtgtctggaacatttaattgaaaatcatgacagagcgaaaaatgatttgaaaattgcatctattgatgcagatggacaagtacttacaattcatacgtctgaaccaaaaccggcacttttaaattatctgggagacccttatggctgtattatcgatgtagatgccggatttgaaaatggaattgttgcaggaacgggaccttacattgcagttgattgtaaaacagatgaccatctgacattggtaaaaaatgagaattactggaatggagagccaaagattgatgaattgacgattcgtacaattaccgatggaaatacactggcaaatgcacttttgtccggagaggtgcaggcagcttatggtatggcatatgaaagttatccgacatttgaaaatgataatttccagttttcacagatttccacttcccgctgtttctttggtaagatgaattttgatgaatcctctgtgtgtgcagattcagcagtcagaaaagcaattgcgatgggaattgataaagaaagttttgtaaccacattgttggaaggcaacggttatccggcaaatggagtatttccggaaggctctgcgtttgggggagataaagttacaacggaaagttatgatccggaaggagcaaaaaaagtcttagaagaagccggatggaaagattcagatggagatggaatccgtgaaaaagatggaaagaaactggttgttaaatggctgacttatccaagtcgtcaggaacttccacttctggctgagtctgtgcaggcaacattaaaagacattggaattgaagtagatattaactgtaccgcagataataattctatattggaagatccgacagcctgggatgtttatgcgatggcaaatgtacaggctccaactggagacccggaatactggtttactgtatttgcaacttctgatgcaacaaagaattcaggaaaatacagcagtgcaaaattagatgaattagaatcacagttaagtaaagaatttgatgaggataagcgagcagagttagccgttcagatgcagcagactattttggatgataatgcctttgtattttgttcgtttttaaagatgagcatgatttcacgttcaaatgtaacaggatatgaatctcatgcctgtgattattatcaggtaaccgcagaccttgatataaactaaaatattgtattgcaaaagtggatattccgtaggggatatccatttttgtccttgtgaaaatttgatgactttggtatgattttaaaaagcaatgagaaaaagcgaggaaaaagaaaatgcttgagacaaaacagctacagtattttgtagtatcagcggattgtggttcttttcgtgaagcagcaaaaattttatatacaacgcagtctaatgtcagcaaggtgattgcggggcttgagagtcaggtcggatatcctttgtttttgagagataggaagggaatcgttgttacttcaaggggaaaaatgttttatcagcaggcacgcagtttgttagaacaattacagaatttagaagatgagagtgaagaacacagtctggaagtggtaagaatttctaccaatccaagttcctggttttcggaatatttttcggaattttatgaagcacataaagaagaacagattcgctataatattcatacggatacgactttaaacatcgtgcagagaatgagaaaaatggaagacgagattggatttgtctatgtgatgccgggtgatgtcctgcggtttgaatatgaattgaaaaaatatcagctggaatttgaagttttaagcgaaacgtttggaatgttgtatttttctgctgaaaactggattaaagaagaaaaaccggacttacatttattaagtgaggtgaaactgattcaggctgaaaaagatccatttcggaaatattcagcctggaagattaaagaaaatggggaacaaatcctgccctgtcaggttgcagttacaacaaacagtgattatattatgaatattatgatgaaaaaaaaccatcttgcaaatatcagttcgagaagctttcacgtctatccgttgggagaagaaccaggttacgtgttgtctgccaaagagggaaaaattttatacggaataataagaaatcggaatgtctcccgaaatcctctcattgaagagatgatagaaaagattcgggagaaaattaatcaggaaaagtaatttaaaaattcttttgctgctgcagacgggatctgaggatggtaagccagaaccagatgacgctgtggcagtttttcttttatctgaagtggatatagatcttcgtgcctctgctgtaaaacaaaatccggaacgaaggcaattccaagaccgattcttgcaaggtcaagcaggagatcattgctggaaagttctacttcgggatttaaatttaagctcttttgtaaaaataaagagtgaagaaattcactggtggtactttttttatcaagcattaaaatcgggtactcgtgcaggtcaaacagggagagtttctgctcggtaaaatcaaagtattttttgttggcagcaaacacatcctgaaaggtaaaaatggttttgtaatttgtgtgaagctgtaacttggaattaggatagttacaaaaagcaaagtcaatctgatgatgttctaaaagttctgcgcatccaatcgaagtagcattggtgaccttgattgtgacttgtggaaattccttgtgaaaacgctgtaagtaagggacaagaaaataacggcagatcgtatcggaagcaccgatgcgaagcggtgtttctaaggtatttgtgccgattaactgtcgttctccctgaaccaaaagattaacggcaggctcaacatggcgaaacaatgtttctccttctggagtcagcatgacacacttggtgttgcgggtaaagagtttatgtccgagtttttgttctaatgatttgatggactggctgactgctgactgtgaaatgtacagttgtctggaggcttcagaaaaacttaaggtagaagcaacgtaataaaaaactttgtaaagttcaaaactgatatccatggaaaaacctctctaaaaaaatgattgatacaaacagtataacaaagagaaaaatcagcgtcaaactatttattatctgaacttattaaaaatataagatatattaattttattaataaaaatttctgtggtatgatgaacatagaaatgcgaaagataacaaaaagatgccctttatggcggtttttatcagaaaggagttatttatgagcagtgtaagacgtgtgtacgttgagaaaaaaccagattttgcagtacaggcgaaagaattaaaacatgaaatttcaagctaccttggcatcaaggatgtaacaggagttcgggtgttaatccgctatgatgtggagaatatttccgatgaggcatttgaaaaagcctgtacctgtgtattctctgaaccaccggtagattttttatatcaggaaacatttgagacaaaagagggagatcagtcgttctctgttgaatttcttccgggacagttcgatcagagagcagactccgcagtacagtgcgtacagttcttaaaagcagatgagaaaccgattattcgttctgcaactacttatgtaattgaaggcggtatttcagcagaagaaatggaagcaattaaaaatcactgcattaacccagttgattcgagagaagctgatgcaaagaaaccggaaactctggttacgaattttgaagagccggcagatgtaaaaatctttaccggattttctgatatgaaagaagaggaattaaaagcactttatgaatctttaaatctggctatgacctttaaagatttcgaacatattcagaattattttaaaaacgaagagaaacgcgatccgtctatgacagagattcgtgtgttagatacttactggtctgatcattgtcgtcatactacgttctctacagaactgaaaaatgtagagtttggagagggcgattataaaactccaatcgtaaaaacttatgaaaaatatctggcagaccgtcaggtgatttataaagacagagatgataaatttgtctgcttaatggatcttgcactgatggcaatgaagaaattaaaagcagaaggcaaacttcaagaccaggaagaatccgatgaaatcaatgcctgcagtattgttgttccggttgatgtagacggaaaagaagaagaatggttaattaactttaaaaacgagacccataaccatccgacagaaatcgaaccatttggtggtgcagcaacctgccttggtggtgcaatccgtgacccgctttccggtcgtacttatgtttatcaggcaatgcgtgtgacaggagcagcagacccgactgtatcagtaaaagagaccatgaaaggaaaacttcctcagaaaaaactggtaagaagtgctgcacatggttattcttcttacggtaaccagattggtcttgcaaccggttatgttaaagaaatttatcatccaaactatgtggcaaaacgtatggaaatcggagccgtacttggtgcagcaccaagacgtgccgttatccgtgaaaattctgatccggatgatattattgtattattaggtggacgcaccggacgtgacggatgcggtggtgcaaccggttcttctaaggtacataccgaagaatcgattgaaacctgtggagcagaagtacagaaaggaaatgctccgacggaaagaaagattcagagactctttagaagagaagaagtcagccatattattaaaaaatgcaatgactttggtgcaggcggtgtttctgttgcaatcggagaacttgccgatggtttaaaaattgatttggataaagtaccgaaaaaatacgcaggtctggatggaacagaaattgcaatttctgaatctcaggaacgtatggcagttgtagttgacccgaaagatgtagaacagttcttaagctatgcaaaagaagaaaacttagaggcaattccggttgcagttgtaacaaaaagcccacgtctggtaatgagctggagaggaaaaacaattgtagatttatcaagagcgttcctggataccaacggtgcacatcaggaaacagatgttttcgttgatgtaccgactaaagaaggaaatgtattagaccgtgcagaagtagacgatataagagcacgctggattgatactttaggtgatttaaatacctgttctcaaaaaggactggttgaaatgtttgacggctctatcggtgcaggcagcgtatttatgccttatggtggaaaatatcagttgactgaaacacaggcaatggttgcaaaagtgccggttatgaatggaaaaacggaaactgtgacaatgatgagttatggatttgacccatatctgtcaagctggagcccatatcacggtgcagtttacgcagtaacagaatctgttgcaagaattgttgcagcaggcggtgattacagcaagattcgtttcaccttccaggaatatttcagaagaatgacagaagataaacatcgttggagtcagccgtttgcagctttactcggtgcttatgctgcacagcttggatttggacttccatctattggtggaaaggattccatgtccggaacctttaatgagattgatgtacctccgacacttgtttcctttgctgtcgatgtagcaaaagaaaaagatgttatcacaccagaactgaaaaaagccggaaataaattagtatggcttcgtatgccaaaagcagagtatgatttaccggattttgaagccttaaaagtacagtatgcgaaactgcatgaagacattcaggcaggcagagttgtttctgcttatgcgttagaccgtcatggtattgcagcagcagtcagtaaaatggcatttggtaatcagatgggtgtaagaattgaatcgaatgtagatgaaagagatttatttaccgcaggttttggcgatattatttgtgaagtaaaagatggaaaagttggcgaactggcaattacttatactgtaatcggtgaagtaacagataaagcagaaattgaatataaaaacatgaagatttctatggcagaagcactggaaacctggaaagctccactggaaaaagtatttaagacccgttccggttctgagacagatgatattacaaagaaagaagacagaggcttatataaagcagacagtatccatatctgctctcataagattgcacagccaaccgtatttattccagtgttcccaggaacaaactgtgaatacgacagtgcaaaagcatttgaacgtgcaggtgcgaaagtgattacgaaagtattcaagaacttagatgcagcggatattcatgattctgttgatatctttgaaaaagcaatcgaccaggctcagattattatgttcccgggcggattctccgcaggtgatgaaccagatggttctgcaaaattctttgcaactgcattccagaatgcaaaaatcaaagatgcagtaaccagacttgtaaatgagcgtgacggacttgcacttggtatctgtaatggattccaggctctgattaaactgggacttgtaccaaacggtgcaattacaggacagaatacagattctccgacactgacctttaataccatcggacgccatatctctaagatggtttatacaaaagttgtttccaataaatctccatggctgcaaaaagcagaactcggaaaagtatacactaatccggcttcccatggagaaggacgttttgttgcaaatgaagagtggttaaagaaattgtttgaaaacggacaggtagccacccagtattgtgatttagcaggtaatatcacaatggatgaagaatggaatgtaaatggttcttatgcatccatcgaaggtattacaagtccggatggacgtatcttaggtaagatggctcattctgaaagacgtggagatggcgttgcaatgaatatttatggagaacaggatattcagatctttgaatccggtgtagaatatttcaaataagataaagtttggaacacaaaattccgctttatataaaacaaaaatcattccttaaatttaaattaagaaagatcgttgcagagccggtcggctctacagcggtcttttttgtcggttagaaattgtactttgaaaataaaaatataaagaaaatcaggataaaaaattagaaaatatcgcaactattagaaaaataaaaaaaattcaaaaaaagtgttgacatttcgactcatttaaggttataatagcagagcagtcaggtaatggctgttaacgaaatgggatcttagctcagctgggagagcatctgccttacaagcagagggtcacaggttcgagccctgtaggtcccattccttttgaaaaaaacaaaagaaataaaaaaagatggcgagatagctcagttggctagagcatacggttcatacccgtagtgtcgagggttcgaatccccctctcgctacttggtcaaaagaccaaaaaagaaaatgggatcttagctcagctgggagagcatctgccttacaagcagagggtcacaggttcgagccctgtaggtcccattccttttgaaaaaaacaaaagaaacaaaaaaagatggcgagatagctcagttggctagagcatacggttcatacccgtagtgtcgagggttcgaatccccctctcgctacttggtcgaaagaccagagattaaatgggatcttagctcagctgggagagcatctgccttacaagcagagggtcacaggttcgagccctgtaggtcccatttcttttgctaaaaaaacagaagaaagaaatgaaaatgtggcgagatagctcagttggctagagcatacggttcatacccgtagtgtcgagggttcgaatccccctctcgctactctttttttatccatttttacatttttaaagaatcatatgcagaacagtgcaaatggttcttttttgttgtacaataaagaaaaactaaaaaatagggaaggaaggtaaaaataaaatgctggaaaacaaaagctcaaattatgataaattaagcgaagaatggcggttgaaatttctggagatggataaagaattagtgaagaaaaaacttccggaaatcagacaggaaaatgatatgttttttattacacattttggagaacagtatggtatttctttaaaagacggaacgatttttttggtaaatcaaagagaaaagccggtgtcaaatggagtaaagatggatatctataacttattctggtattctaaagaagatgcctttttcatgaaccgctgggtcccttttcgggatgtaagaggtgcttctccctttacaccggcatttgagagaaatgtgcttatgccgtttgcaaagacgtttgaaggacatacagaagaattaaaaaaggcagcggaagcaattggaggaacaagtgtgaaacaaggcgatgtcggatatatcattcctgcatttgactgtattccgatgcagtatttattttgggatggagacgatgaattttcagcacaggcaaatattttatatgattatagtgtgacggattatattcatgtagaatctacggtatcccttgcgacagaaggaattttaagactggcagaaacagcaggtttggaactaaagggaaatatttttagaatgtaaaagtagaatcccctggatagggttaaaaaagtaaaaaaaagaataaaaacagtgaattttcaaggcttgaaaaaaatgaaagtaaaatccccccaggtggcttgcgaagtagaaaaagacagggtattatgaattcaaggttatgaaattcgtcttcctcttttacgaataaccttaactttacagtattgttggacttgtagaatacctctgcaaaaactacaaatcctctaagaatttcgttgaaaaagaattccgtacgataaaatgtatgggattcttttttcttgtaaaggaaaaaggaattcgatacaataaaagaaaacagtaagggagaaaaagtaaatgcaaaaagaacaaaaatggcttgactgggcggtggaattacagagtcttgcgcagagtgccctgtattattgtaaagataagtttgatatagaacgttttgagcggattcgggaaatttccgcagagatgttaagtgaagcgtcaggacttccgacagaaaaagtaaaagaaatcttttgcaatgaagtgggatttcagacgccaaaattagactgtcgggcagcaatctttaaaggggataagattttacttgtgcaggaaaataataagacatggtcactgccaggaggctgggttgatgtagaccagtctgtcaaacaaaatacgataaaagaagtaaaagaagaagcgggactggatgtgacagcggaccgtgtgattgcagtgcaggacagagagaagcataatctgccgatttatgcttataaagtatgtaaaatttttgtacagtgcagtgtaatcggcggagcatttcaggaaaatattgaaaccatacagagtcgatatttttcactggatgaactgccaccgcttgcagaagaaaaaaatacaaaagaacagattgagatgtgttttcaggcgtatcgttccaaagattgggagacaatgtttgattaaaagttataaattagtggcgaaaccccataagcttgcctgtgggagtagtcagcaactggaataaattttaaaacaacttgtcaataccaccatacaagttataaaataaaaaccaaaggagtgtgtatagtggcaaacgaaaatggaaagacaaaatattatgcactgatggaagaattaaaacaggcgattttaagtggtcagattaaaccgggagagaaacttccatccgaaaatgagctgtctgcccgttatcaaatcagtcgtcacacagtccggaaagcactgtctattttgattaatgagggatatattgaggcagaacatggcaggggaacattttgttctcagagaatgggacatttgaagaactcaagaaatgtggcagttgtgacgacttatatctcagattatatttttccgcgtctgattcaagggatggataaggtactgacggaaaatggttacagtattattctgaaaaatacagcaaacagcagaacaaaagaagaaaaagtgcttgaagatattttgacaaaagatattgaagggctgattatcgagccgagtaagagccagattttctgcaggcatacgaacttgtatggtatgctggatgagtatgaaattccttatgtttttattcagggtgtatattcccagatgttggataaaccacatatattaatggatgactgcaagggcgggtatatggtgacaaaacatctgttagattatgggcataagaaaattttaggtatttttaaggcagatgattctcaggggagagaacggcataagggatatgtaaaagcattgcaggaagcaggaattgcttatgacccggatatggtggtatggtttcatacagaggacagaaagacaaaaccaggaatgattatggaactgttgttaaagcagaaaaaagagatggacggaatcgtctgttataatgaccagattgcgcttgaagtcatttactgtctgaaaaaaaatggagtccaggttccgacagatatctcagttacgggatatgataattctgtaatcggagagggaatgggaggtctgacaaccattacgcatccacaggaaaaactcggtgaaatggcagcggaattactgcttgaaaaaattcgaaaaatcccggaagaaaaaagtaagattccgagattgatcgaaccggaattaattgttcgaggttcaacgagaaatagaaatcaaaaataaaagaaacacgaaaaagaaagtgaggacaaaagaatgttagaagaattaaaaaaagcggtatacgaagcaaatatgcttttacctaaacacggactggttacatttacctggggaaatgtcagccagattgacagagaaaccggatattttgcaatcaaaccaagtggtgtggattatgataaactgacaccggaagatatggttattatggatttagaaggaaataaaatcgaaggaagatacaatccgtcttctgataccccaactcatctggagttatacaaagcatttccaaacattggcggtgtcgtacatacgcattcttcatgggcaacaagctgggctcaggcaggacgtggaattccatgttatggaacaacccatgccgactatatgtatggagaaattccatgtgtcagatgtctgacaagagaagaaattgaaggtgcttatgagaaaaatacaggacttctgattgcagattactttaaagataaagattatgaagcagtgccggcagtactttgtaaaaatcacggaccgtttacctggggaaaagatggacatgaagcagtacataatgcagtcgtattagaagaagtcgcaaaaatggcagcacgttgtgaaatgattaatccgcaggtaaaaccagccccacaggaactgcaggataaacattattacagaaaacatggtgcaaatgcttattacggacagaaataaattttggatataaaaattccgagaatatagaatgaaaaacggaggaaacaaaaatgggtttcgatgcaaaaagcgtaattgaaaacggaaaagcagtacttggtattgaatttggttcaaccagaattaaagcagttttaatcggagaaaataatgaaccgattgcttccggtgcacatgactgggaaaaccgtctggagaacaatatctggacttacacattagaagatatctggacaggtcttcaggatagttataaaaaaatgacagaagatgtcaaagaaaaatacggagtagaagtaaagaaactggctgctcttggatttagtgcgatgatgcacggttatatggcatttaatgaaagcgatgagctcttagtaccgttccgtacctggagaaataccatgacacagcaggcatctgatgagctgactgaattatttcagtttaatattccacagagatggagcattgcacatctttatcaggcaatgttgaataaagaagaacatgtatctaaaattaaattccagactacgcttgcaggttatattcactggaaactgacaggaaagaaagtacttggtgtaggcgaagcttccgggatgtttccgattgatatgaatacaaaaacctacaatgcaacaatggtagaaaaattcaatgaaaaagtggctgaaaaaggatacagctggaaattagaagaaatctttccggaagtattaagcgcaggagatgcagcaggtgttttaacagaagaaggtgcaaaactgcttgatacgacaggaacattggaagcaggtgtgccggtatgccctccggaaggagatgcaggaacaggtatgactgcaacaaacagtatcgcaaaacgtaccggtaacgtatctgccggaacttctgtgtttgctatggtagtactcgaaaaagaattatccaaagtatataaagaaatcgatatggtgactactccgacaggaagtccggttgccatggtgcactgcaacaactgtacttctgacttaaatgcatgggttggactgttcaaagaatttgcagaagcatttggaatcgaagtggatatgaataaactgtttggaacattatataataaagcacttgaaggtgaaaaagactgtggcggacttttagcctacaactatttctcaggagaacatatcacaggatttgaagcgggtcgtccattatttgcacgtacgccggacagcaaattaagccttgcaaactttatgcgtgtgcatctgtatactgcacttggcgcattaaagacaggtttggatattttgttaaaagaagaaaacgtaaaactcgataagattcttggccacggtggtctgtttaagacaaaaggtgtgggacagaagattatggcaggtgcagtcggtgttccggtatctgttatggaaaccgcaggagaaggcggggcatggggaattgcccttcttgcctcttatatggttaacaaagcagaaaatgaaacattagatgattatctgaataataaagtatttgccggaaatgcaggaagtgaaatggaaccagatgcagaagatgtaaaaggatttgatgcatttattgaacgttacaaaaaaggacttccgattgaacgtgcagcagtagaaaacttacagtaacaaatagcagaactcacagggataaaaaaatccctgtgagttttttaatatagaataatttatccaatcaacgcgagaatgtaaaaaaatatttaaaaaaaactattgacagaaataggataattgtgtatactaatcacagttagataaagctaaccaacaacacacacactacatacacaggcggctgtaaagacagtcgccaaaaaaagagaatggagttagaaaggactaactttaaatagaaaattgatataaaccactaaaaactgttttgaaaggagaattaaaatgagtattgttattgtgggcggaaatgagagaatggtctgtcagtatcagaatatctgtaaaaactacggctgtaaggcaaaggtatttgcaaaagaaaaaggcgctatgaaaaagaaactgggctgtccggatttgatgattttgtttacaaatacagtatctcataagatggtgaacagcgcattgcaagaagcgaagaagaataatattccgattgcgagaatccatacaagcagtgcagccgctttacacacagtactgaacgaatatacaggaaaggaaagtgtagtatgctagaacagtatctggtggagcattgttcgccaacccttgccggattaaagacggcgaatcttttttcagttcgttttattgatgaagaagagttaaatcagcatatgaaacagtgtgaaaaaaaatttcagaataagggagtctcattgattctcttgaaaaaaagagctgatacggcattgatttatgtatgcagaagagagaaacttcaaaaagatttacagaaaaacggtgtaaaagaatttctaaaaaagtatggatatgaaaatactgatgaagaagaggccattgcgtgtttaaaggcacgattaaatttagaagaaaaattccctcatgaaattggactgtttcttggctatccgcttggcgacgttattggatttatcgagaacgcaggaaaaaacagtaaatgtgcaggttgctggaaagtttactgtaatgagtgtgaaacaatgaaattgtttgagaagtttaaaaagtgtacaaggatttacacaaaactttggagacagggtacaagtgtagaaaaactaacagtggcagcttaaaaagaaaaaaggagacgaagaaatcatgagtaaaattgcagttgtatattggagtggaacaggtaatacagaagctatggcagaggaagttgcaaatggagcaaaagctgcaggcgcagaagtagaatcctttacaacagatgattttgctgcagataaaatgaatgattacgatgcagttgcatttggatgcccggctatgggagatgaagtattagaagaggacgaattcggaccattatttgaggactgtaaagcaaaactttccggtaaaaaaattgctctgttcggttcttacggatggggagacggagaatggatgagaaattgggaagaagactgcaaaacagcaggtgcaatacttgcctgtgacccggttatctgtaatgatgaaccagatgatgacgcaaaagaagcttgccagaaccttggaaaagcacttgcataaataaattcaagaagaaatataacaaatacaagaaatataaccaaatagaatcaaaataaaaaataaaatataacgtaaaaagaataaagagaagagaagcgaaagtggagtagaagtgttgacttttactctgctttttgctatgttcaaagaaaactaaaaaaggagaacttcaaaaagatgatgcgtgtaggaatgggatatgatgtacacaaactggtagaaggacgcgacctgattcttggtggtgttaagattgattgggaaaaggggctgcttggacattcagatgcagatgtgcttttacatgcgattatggatgcacttttaggtgcagcagcccttggagatatcggacggcattttccggataccgatgagaaatataaaggaatttcaagtattaagttattacagcatgtaggggcattgttagaagagaatatgtacgtgattaataacattgatgcaacgattattgcacagaagccaaagatgatgccgcatattgaaaaaatgcgggaaaatgtggccaaagctctgaatattgaaaaaaatcaggtcaatatcaaggcaacaacagaagagggacttggatttaccggaagtggagaaggtatttcttcacaggcaatctgtgcacttcaagatgccagggatttcatggcagatgaccgtataatgccggcaggatgcggtgcatgctgtaaaaaaaattaaaaggtacgtcaggagttttggcgcacataaaaaacatcaggagaaaaagaaagtatgagtatattaaacgtagaacatttatcccatggatttggtgacagggcgatttttcaggatgtgtcctttcgtctgttaaagggggagcatatcgggcttgtcggagcaaatggagagggaaagtctacctttatgaatattataaccggaaagttgatgccggatgagggaaaaattgaatgggcaaagaatgtaagagtcggatatctggaccagcatacggtgcttgaaaagggcatgacaatccgtgacgtcttaaagtctgcgtttggatggctgtttgaaatggaagaacagatgaatggaatctgcgataagatgggggaagcatctgaagaagagttaactcagatgatggaagaacttggaacaattcaggatatgcttacgatgcatgacttttatattattgattctaagctagaagaagtggcaagagcacttgggcttacagaaatcggtctggataaggatgtgacggatttaagcggtggtcagagaacaaaagtattgttaggcaaactgctattggaaaagccggatattttgcttttggacgagcctacgaactatctggatgtggtgcatattgaatggctgaaacgttatctgcaggagtatgaaaatgccttcgtgttaatttcacatgatattccatttttaaatcaggtcatcaatctgatttatcacatggataaccagcagttaacacgatatgtgggcgattatgaccattttcaggaagtttatgcagtaaagaaagcacagcttgaagcagcttatcagaaacaacagcaggaaattagtgaattaaaagattttgtggcaagaaataaagcaagagtggcaaccagaaatatggcaatgtccagacagaagaaattagataaaatggatgttattgaactggcaagagagaaaccaaagccggaatttcagtttaagactgcaagaacaccaagtcgttttgtggtagagacgaaagaattggtgattggatatgacgaaccgctttccaaaccgcttaccttgacggtagagagaggtgaaaagattgctttagccggcgcaaacggaattggaaagactacgcttttaaagagtattttgggactcattccggcacttggcggaaaagcagtgcttggagattatctggagattggatattttgagcaggaaatgccacagggaaataagcatacctgtatcgaggaaatctgggaagaatttccgtcttatacacagtatgaggtaagagcctcacttgcaaaatgcgggctgacgacaaaacacattgaaagcctggtacgagtcttaagtggtggagagcaggcaaaggtgcgtttatgcaaaattattaaccgtgagacgaacctgcttgtacttgatgagccgaccaatcatctggatgtagatgcaaaagaagaacttaaacgtgcgcttaaagaatacaaaggaacaattttgatggtctgccatgaaccggagttttacgaaggactggtttcaaaggtctgggactgctcggagtggaccacgaaaattggctgaatcaaatgccggactttatgtaaaaagtgctttaaatcgacaaagtatatgcagtttttataaaaaaccactgcaaatttcgtcataaaaccgatgatttctccaaaaactacgaaaaatatgaaagaaataaaatttcagcttgcaaaatctgtccaagagttttataatcaatttgagtttacaaatagcgaaaatgaatcaatattaggaggacagaaagtcatgtcatacgtagatgaggttattgaatcagttgtaaagaaaaacccaggcgaaccggagtttcatcaggcagtaaaagaagtacttgaatctttaaaaccggttgtagaagcaaacgaagaaaaatatcgtaaagaagctttattagagcgtcttgtagaaccggaacgtgttattatgttccgtgtaccgtgggttgatgacaaaggtaatgtacaggtaaacaaaggatatcgtgtacagttcaacagtgcaatcggaccatacaaaggtggtctgagattccatccatccgtatatcttggaatcattaaattccttggatttgaacagattttcaaaaactcccttacaggtctgccaatcggtggtggtaaaggtggttctgatttcgatccgaaaggaaaatcagacagagaagttatggcattctgccagagctttatgacagaactttccagacacattggcgctgatacagacgtaccggctggtgatatcggtgtaggcggaagagaaatcggatatctgtttggacagtataagagaatccgtgattcttacgaaggtgtactgacaggaaaaggtcttacatttggtggttctttagttcgtacacaggcgacaggatatggtctgttatacttaacagaagaactgttaaaattaaatggaaaagaccttgctggtaaaacagtagctgtttccggtgcaggaaacgttgcaatctatgcaattgaaaaagcatatcagttaggtgcaaaaccagtaacctgctctgattccacaggatggatttacgatgcagaaggtatcgacttagaagcattaaaagaaattaaagaagtaaaacgtgcacgtttaacagaatacttaaactacagaccaaacgctgaatatcatgaaggcaaaggcgtatggagtgtaaaagtagatgtagctcttccttgtgcaacacagaacgaattacagttagaagatgcaaaacagttagtagctaacggatgcttcgcagtttgcgaaggtgctaatatgcctactacattagaagcaactcagtatctgcaggaaaatggtgtaatctttgcacctggtaaagctgcaaatgctggtggtgttgctacatctgctctggaaatgtctcagaacagtgaacgtttaagctggacatttgaagaagttgatgaaaaacttcagggaatcatggttaacatctgccacaacatggtaaatgctgctaagaaatatggtcatgaaggcaactacgtagtaggtgcaaatgctgccggatttgaaaaagttgcagaagctatgatggcacagggtatctgctaatcaaaatttggaaaataaattgctataaaaacagaaaaaccgtggcgtttaaaaaacgttgcggttttttcatctagtgaatccaaaagtagtttcggagtgaaatcaaaagtggttctgtgaaatagaggttgacaaatttgtcatttatgaataaactagaacaagacagattaagataaatttaagatataaaaaagcgatgaatggaaagagtaccacagaaattttttacagagaaagagggtcatcggctggaagccttctaaaaaggaatgtgtgaaagtgcctccagaagctgacagctaatccctgtccgtaatcctgcgttaaaggaagaaaagcggaggaatgtatcctcaagtagagtggaaccgcggaatatttcgtctctatatggcacaagtcatatagggatttttttatgagttaatttaagaataaacaaaaaagaagggaaagaaaatgggatttatcaagcatattaaagaagaattccaggtgattcaggaaagagacccggcgattaagacaccgctggaagtgctcttatatccaagctttcgtgttatgattcagtatcggaaagcgcataaactttaccagaatggacattattttcttgcaagatggatttctcaaagagcggcaagaaaaaccggaattgaaattcatccaggggcacagattggaaaagggctgtttattgaccatggaaacggtgttatcattggagagacagcaattattggagataatgttaccttatatcagggtgttacgcttggaggtaccggaaaagaaaccggaaaacgtcatcctacgttaagagataatgtaatggtgagtgcaggagcaaaagttatcggttcttttacgattggtgaaaattcaaaaattggagcaggaagtgtcgtacttgaagaagtaccgccaaactgtaccgtagtaggtgttccgggacgtattgtaaaaagagaaaacagaaaagtgccgagaagcgatatggatcagattcatttgccagacccggtattagaagatattcgtactttacagaaagaaaatgaagcgttaaaatccaaattacagagaatggaatatcagctgcaggagataagagaagaaaaggagaaaaacggattatgaaaatttataacacactgacaaagaaaaaagaagaatttgtaccgcttgaagaaggaaaagtaaaaatgtatgtgtgcggaccaacggtatacaactttattcatattggaaatgcacgtccgatgattgtattcgataccgtaagaagatatatggaatacaaaggctatgatgtaaactatgtttctaactttaccgatgtagatgataaaatcattgcaaaagcaattgaagaaggggtgtctgcggaagaaatctccaaacgttatattgcagaatgtaaaaaagatatggcagatatgaatgtaaaaccggctaccactcatccgctggcgactcaggaaatcgatggaatgattgacatgattcagactttaatcgaaaaaggatttgcttatgaggtgaatggaaccgtatacttccgagtaaagaattttaaagaatacggaaaactgtctcataaaaatctggaagatttacagtctggttttcgttccattcaggtatccggtgaaaatcagaaagaagaccctcttgatttcgtattgtggaaaccgaaaaaagacggagaaccattctgggtatctccatggggagaaggcagaccgggatggcacattgagtgctctgttatgtccaagaaatatttaggagaagaaattgatattcatgccggtggagaagatttagtattcccgcatcatgaaaatgaaattgcacagtctgagtgctgtaatggaaagcagtttgcaagatattggatgcataatgcatttttaaatattgacaatcgtaagatgtcaaaatctctgggtaacttttttaccgtacgtgaaatcggagaaaaatatgatttacaggtgcttcgtttctttatgctcaatgcgcattacagaagtccgttaaatttcagtgcagaattgatggaagcttccagcaatgccttagaacgtattgtaacctgcgtagagcagttaaaacattatttggaaaaagcagagggcaatgagtatgcagaagcagaaactgcgcttgtgaaagaagtagaagcgctggtggaaaaatatgaagaagcaatggaagatgatttcaatactgcagatgctattgcggctatttttgaaattgtaaaacttgcaaacacaaacacagatgcggaaagcacaaaggcatttgtacagttcttatttgataagattgtagggttaagtgatatcttaggattgattgtaaataagaaggaagaagtgttagatgaagaagtagaaaagctgattgaagaacgtcaggctgcaagaaaagcaaaagattttgcaaaagcagatgaaatccgtgacaaattagcagatatgggaattatcttaaaagataccagagaaggagtacaatggaagcgagcttaagttatttaaaagagctgtttgcactggggaatacggatattaagacgtattccccactgacactggcttatatcggcgatgccgtgtatgagattgttgttcgtacggttttggtagaaaaaggcaatgcacaagtcaataaactgcatcagagggcaagtaagctggtaaaggcttctgcgcagtctgaaatcattgaaaaattaaaagaggatctgacggaagaagaacttgccgtttataagagaggcagaaatgcgaaatcttatactatggcaaaaaatgcaactatgtctgattatcgaagagcaaccggatttgaagctctgatgggatatttatatctgaccgaacagtgggagcgaatgttacagttgattaaaaagggaattgaaaaaggagaaacggatggaagagaagttccaggaaagtaaagtagagggaagaaatgcagtattggaggcatttcgttccggtcgtgtaattgataaattatttgttcaggaacattgtgaggatggtccagtaagaacgattttacgagaagcaaaaaaacatgatacaatggtgcgttttgtaaaaaaagagcgcctagatcagatgtctgacactggaaaacatcagggtgtgattgcaatgacggctgcgtatgattatgcagaggtatcagatattttagaaaaggcaagagaaaagggtgaaccgccatttattattttattagataatattgaagacccgcataatcttggagcaattatccgtactgcaaatctggcaggtgcacatggagtcgttattcccaaaaaccgtgcggtcgggctgactgcgacagtggcaaggacttcggcaggggcattaaattatacaccggttgcaagagtgaccaatatggcaagaacaattgaagacttaaagaaagagggattgtggtttgtctgcgcagatatgggtggaacaaatatgtatgaccttgatttaaaaggtgcaattggtcttgtcattggaaatgaaggcgacggtgtatcaagagtagtaagagaaaaatgtgattttattgcttcgattcctatgaagggagacattgattctcttaatgcatcagttgcggcaggtgttctggcgtttgaaattgtaagacagagaatgtaaagaaaataaaaagatgaaagatttacaacaatatacggatgaagaattaattgtacagcttcgtaatggtaaccaaagcgtggaaacgtatctgctcaacaaatataaggggctggtcttaaaaaaggcacatgcgatgtttttagcaggtggagagacagaagatttgattcaggagggaatgattggactctttcaggcagtccgtgattatcagccggataaaaatacgctgttttcgacgtttgcaaatctctgcgtagtacggcagctttgtaaggcaatcgaagtttcaggaaggaaaaaacataaaccgctcaatgcgtatgtctctttaagtggagacgattctccacttttagaagcatttgatttcagccagcagaatccggaaacgattgtgattgacagagaaaatacggagcagatgcgtaataaaattcgggaatgtttaagcgaatttgaaaacgaggtgctggatttgtatcttgaaggaaagacttatacgcagattgcagtacttatggaaaaaacaccaaaatcaattgacaatgcactacagcgaatccgtggcaaaatcaaagaattgtcgctggattcgcgttaattgagaggactcataaaagaatctttgcattaacataaaaaataaaagaaatattacaaaaagtattgacatttcaaacaatttttgctagaatctgtaattgtgatgaacggcttgtgatatcacaagtcaggctgccttggctcagttggtagagcgtcgccttggtaaggcggaggtcggcggttcaaatccgctaggcagcttgtaaaaaacctctctgagatttcagagaggtttttttgaatgctttacaaataattaaaacgaatgccttttttaaatatagtattcaattgtttcgtgagatttcatattaaagatttcgtagactttatcacgaatcatcaggaaatcattggaagtacggtctctgtgttttggaagctgtaccgtaaggagagccttaattcgtccggggtttgcggacattatgacaattcggtcggcaagaaagacggcttcttcaatatcatgtgtgacaaagactacggtcttttttgtgtcctgtgcaatttccagaatgtctgtctgaagtttcattcgagtgatggcatccagtgcaccaaatggttcgtccataaataaaatatccggttctacggcaagggcacgggcaattgcgacacgttgctgcataccaccggaaagctgtgccggacgtttttttgccgcatgttcgaggccaaccatttttaaataatgagaggcaatgttggctttcttttctttgctgtagttttttgtctcgagtcccagttctacattcttttgtaccgttctccatggaagcagtccataattttgaaaaatggtgacatatttcatggaaggtttctgaacaatctgattttcgattttgatttcgccggatgtcggttttaaaaatcctgccattgcatttaaaagagtagattttccacagccggatggtccaagcaggcaaataaattcccctttttcaatatttaaagaaacatcatctaaaatgacatgagtttgattttcttcttcaaaagaaattgttacatttgatacatctatcattttttacgctccaaatccgaattttgtacgaatcagtttctcagctatccgaagaaatccatctaagataaaaccgatgacaccgatagttaacatagttgcaagtaaagagtcaaaccgcatgcagttttttgtatccataatcaggaaaccaagtccggactgagaaccaaccatttcaccggatacaaggaaaatccaggaagttccaagtgccagacgaagtgcgttggaaatctgggtaaaaatggcaggaaagataatacaaaataatgtttttactttatttacaccaaagctgtctgcgattttataatagattttatcgacattttgaactgcactgacaacagagagcagaattgggaaaaatccggcgataaagatgattacaattgcaggtacatcaccgattccaaaccagaatacgataaatggcatgaaagcaacgggtgcaatcgggcggataatctgaagaatcggattaataaaggtaaatacacgcggaaaacttccaagtaacagtccaagcagaattgccgaaacagcagatgaaaaataaccgatggcaaaacgaataagactggtttcaatatgaagaggaagtataacagaagaagtacttcccggcagtccggtcgtacaaagctgaatgaatgcctgtaatactttatatggagacggaaacagggtttcattggtgtgggcgagggtgcaggctgtctgccagagcaccactacaaccacaaaagaaagaatcgttcgtattgtcttttttaacataatcttttgtcctcacaatctggatactgatttactggtaaatgaaatcattgtaggacggtggattatcgttgattccgtattcttttactttttcacttaattgttcataatcatcaagtgagatgtcaaggtcatcgtaatgaatccattctaatgagacatcaagagttttttcgtcctgtcctaagtatttttcagctacttcttttgcgattccttcgtccaataaacttccggcttctttgtatgtagaaagaaattcgtctgcggcctctttattcttatcaaggaatccgccgttaaatacgagtgcacagcagatagaatcctgccataaatcagtggaatcatataatacgtgaccgtaaccctgtacaatagcctgtgcgccaaatggttctgcaacacagtatccatcaatggaaccgcttgcaagggaagaaggcatttcagatggagcaagctgtaccacattgatatcatcaatacttaagtcgccaagtgcaagcatgtcatttaataagatattgtgtgaggactgattagaaggaattgcaaaagtttttccttttaaatcacggacatctgaaatatcatcagatacgatgacaacatttccgtctttatgaccaagagcagcagcctttaagtcaattccgttacttacggctcccattgcaagttcaacgagaacagaagcaccatcgatttttccggagttcagtgcatccattaaatccgtccaggaactgaatttttgaagagtgacttcaatatcgctgtctgattttttatctaaaagttcttttgtctcaaacacagccagtgcatgtgtgattggcagatagcctaaggtaatattggtttttgaagagtctgtttttgtagtgtcagcggctgaggtagagtctggatttgtggtaccgcagccggtcagagcactaaaagaaagtgtagcggctaaagcaaatgtaagtaagcgtttgaatttcatggttatactcctttaattatagttaaattcctaattgttttcgtttttctttcatatctgcgacaattttttcgccaagtgcaacagggtcggcatcgacaatcattgcagaatgaagtgtttttttcgttccttcttttaagaactcaatgactttagaagaaccgtgaattggagcttctacacaatggtaggagctgattccgtttaagcggaagccaagagcggcatcgattcctttttcattggaccattccggtgaggaaaaagcaaatggcatttcgtagagtgctttgttaaattcaccggcaattcctccgaaaataccagaagaacgggtattgtcaatacattctccaacatgccatacgggaggcatatccggatttaaaaattctcttaaaccatccccgcatttactgtaggcaaattcagaagtctgacagtatcccattttcataagagggaaggaagcacatccgtttgtgataataagtacgttattttttaacagtacatcacagacatctaagattgctttttcataaaggacttttggattgttacatccaaccatattgactactccgagaatcttgccggagcggatggcgtcggcaatcggtttgaaactgccgtattttttacagatgtattcaacagaaaatccgacttctgcttccacttcgtgttttggaataaagaccggaatgccttttcttgcttcaaaactttcgatggcacgcatgacaatccgttttgcaattgctttggtttcggcaacattggagtgatggtggtcatatccgatgtgttctgcacctggaaggcgggcagaatcatgagtagtaacaaccgttgttttaaaacagcgtgctacatccatgatagccggataaacttcctgtacgtcggcaacccagaggtcaagcgcacctgttccaagtaccagttctgcgctgacggcattagaaagaggaatgactccttcatagcggtacattgcggagagaccggaacagcagattccataaaactggataccttttgctcctttttcttttgcaaggtttaagagttcttcactttgtccggcttttacaatttcttttaccagaaccggaagatgtccgtgaactgcaatgttgacatagccttttttgagggcaccgatatttactttggaagtgacacggtcaccgaccccgagcagggcatctgttgcaatggaagtggaaacgaccccgctaaaagtaaaagcgagtccacagcgcaaaaactgtttcataacactttcccagtcgccatctgtcgcacatccggttttatgataagcttcaaaaacttcgtggtaagcactgattggaagaatatcaaggtctttccatactttctggcgttctggagttgcacaggcagaaatgactttgtattcatccggctcggttctggataaatcatcaagcagagtatctgcaaggtcaattgcaatgttttttaacgtacgttttttagttttgattccgaaggcttctgccatggagcgtactttgtattctccgatgattggaaggtcaagtttgccctgggcagcccattttaacattaagagcaattctctggcgtgcatcccgtgttgggcagcaccggcagcagcaccacgcagaagatttcttgcgacaattaagtcggcatctgcaccacagactccgcgaggagacttcggggtgattttacaaggacccatgttacagatacgacagcaggttccgcttaaaccaaaggtacattgtggctgttgtttatcaaaacggtcaaatgcagtgtcatatccaagctgttccattcgaagcatcatttcttttacagcagggtctggaacattatcaagcacatcctgtttggttggaaaggttttgcggtaagcagaaaccgctttcctgtagtcctcggtaaagacttcttcatggctgtgttcatattcgttgccgttttcatcaatatgtttatgagtatgaccgctgaccggtactaaaacctttgggattccgtttttatcaaagccgataatggctctgtgattatgtggttcaataacggtgttaaatgtttcatcagttgtatttttattttccataaattaattctccactaaattacttggtttttggttaacgagatagtaccactaaaaacatagtttgtcaataggtttagggggataaagtgaaaagttgtgaaaaaaatgtgaaataaaaataagaaacttgacagaaaaaaacactggtgttatattacaaatagaacaaaaaacggaaggaggaggaaacaatggctgtaaaacgagattattatgaagtgttgggagtgtcgaaaaatgcagatgaaaatgcgattaagaaggcataccgaaaacttgcgaagaaatatcatccggatacaaattcaggcgatgcggatgctgaaaaaaaatttaaagaagttacagaggcatattctgttttaagtgataaagaaaaaagaaaattatatgaccagtttggtcatgctgcgtttgatgagggagccggcggcggaacttatcagtcgcaaaatcaaaatggaggatatcaaagagcgtaccattttaattccgatgatatgggggatatctttggggatattttcggggatatgttccatggaggacagagaagtggaagaagaagcaagagcagcttctatcaaggcggttttggaaatggctttggaggcggttttggagcggatttcgcacaaaaaggtgaggatttgaatgcagaagtgaccgttacatttgatgaagcggcatttggctgtgataagagaatccgcctgtctttacaaaatggtcagacacagactttggaggtgcatattccggcaggaattgaaaccggaaagagtatccgtttaagaggaaaaggacacccgggaagcggaggcgctgaggcaggagatttactgttaaaagtaacggtcatggaaaaatccggctatgaacgaaaaggaatggatgtctatacaaaagttcaggttccgtttacaaccgcagtatttggcggagaggctatggtaaagaccctttatggaaatgtcatctgtaagattcgtccaggaacacaatccggaacgaaaatccgtttaagaggaaaaggaattgtatcgatgaaagatgcttcggtacatggagaccagtatgcagaagtagaaatcttggttccaacggatttaagtgtagaagcacggcagaaattaaaagaatttgaagcactatgcaaaaaaaaacaagataatcggtcagtagcataaggaaaaccgcagtatcaagagaaaatgatactgcggtttttgcatgtttaaacactttgtaaaagttagtttctttgataaatccgaactaattttttgattttattttgtaaatccgaagtaaattctccatctaagagacgccatttccagttggttcctaaagtagatggagtattgattcggcaggtgttgttaagtcccagataatcctgcattggaatcatacagatacgtgcagggcttcccataacacggcagataactgaccagtgcagactgcggtcagaagttgtataatcatgaatataatcgcgtaacatttctctgctctcttttgggatgtcctgataccatccgattaaagtcgcattatcatgagttccggtatagacaacagagttgaccggataattatgtggcaggtaatcacctgcacatccggtatctctggaatcaaaggcaaattcaaaaactttcatgcctggaaatccgctttcaaaaaccatctggcggacactatccgttacataacctaagtcttctgcgatgacgtcacgttcaccgagaacttctttcatacggtggaataattcaattccgggacctttttcccaatgaccgtttcttgcagtggtatctccataagggatagagaaatattcatcaaagccacggaaatggtcgattctgactacatcatagagataaaatgcgtaagaaagacgctgcatccaccatgtataaccggtccggcggtgataatcccagcgataaagcggatttccccatagctgtccgtcagcggcaaacccgtccggagggcatccggcaaccgcaagaggaacattttcttcatctaactgaaagagttccggatgagcccaggtatctgcactgtcataagcaacgtaaatcgggatatcaccgatgatgcggataccgttttcatttgcataagtttttaattttttccattgaatggaaaattcaaattgcatgtatttctggaattcaatttcaaaataaagctgttcgcggtaataatcaagggcatatccgtaacgttttttgatatcctccggccacttatcccaacattcgtcttgaaagaatccttttacagccataaataaggcgtaatcgtcgagccaccatgcattttcttcctggaatgtccgaaattctggattttgggaaatattgcttctttcataagcttttcgaagcagtttgtagcgggctttataaagttttccgtaatcaataaaacgagaatccaaaccaaaatcagcaagatcacattcttttttagtcagaacgccttcttcgattaaggtatttaaatcgataaaataaggatttccggcataagtggaaaaagactgatacggggaatctccgtaactggttggtccaagtggaagaatctgccagtatttttgattggccaaagccagctggtctacaaattcataagcttcttttgaaaaacagccgatgccgtattgggacggcaggctggatatcggtaataaaataccactttctctcataatataaaaactcctttcttttgtcgcaaaaagcttcttcctggttagagctatgtgtgaataaagatattctaacacagggagaagcatttttaataaaaattaaagttctaaaattaaagcctgatatccatgaagtgttactttgtttccgtttaatacaacatcattatagttgtttaagagaacggatttatatggagctggaagagcaatggtctgttcttgtgtctgatagtttccgataacaagaagcgtcttgtctccttttctgtaataagccatcaggttatgtgtatcttcaagatacggaatgacatcaccataaacgattgtttcctgataagcaggatcttttctaagtgcgattaatttcttataataagaaagaactgaatggtcatcatgtaactggctttctacattaatctgggtatagttcgggtttaccatcagccatggggtgcctgttgtaaatccggcatttgtgccggcattccactgaaccggagttcttgcattatcgcggttataaagggaaataatttttagggcttcttcttcggagtatccggcttctattgctacatggtactggtcaagtgcggaaacgtcatcaactttttcaaaaggaattacaccgagattttccataccaatttcctgtccttgatagatgaacggaagtccacgaagcatgaagtataatgtagccagcatttttttgctttggtcggaacactctccttccggaatataatagctgacaccacgtggttcatcatgattttcaataatgttagataaaaatccgatcgaaccgattcttttctgagagtggaaacaacattttttataatcatctggagtaatgcgggtatttgcataccagcctttatcactttttccaaaggaagtgccggcaaaatcaaacatggaagagaagtagccgttatctccgatgaaatccggaagctcttcgtctttttcattaaaaacttcaccgacggtaaatgcattatgaggattaaaggttttgtcacgcatttcgcctaaaaattcaccaacaccctttgcatcagcaagcatctggtcgatacagcttaaattatcatcgcggtctaccgtgtagtctttataaggaagtttctttttgatgttgatgatagcatcaatacggaaaccgccaagtcctttatctaaccaccagttgatgtttttgtaaacttcttcgcggacttttggattttcccagtttaaatccggctgttttttgtgaaatacatgcatgtactgcttgtcaggatgtcctggaagtggttcccagaccggacctccaaaataacttctccagttacatggaagttctccctctttgcggtcttcaatatagaagaagtttccatattctccgtcagggtcttcacaggctttttcaaaccattcatgttcatcagaacagtgatttacaaccaggtccattaagatatacatgtcacgttttttggcttcttttaaaagatgatccatgtcatccattgtgccgaagcaagggtcaatttgatagtagttagagatatcatatccctggtctgcaaatggagaagagtaaattggagaaatccagacaatgtctactcctaattcttttaaataatctaattttaaggtgattcctggcaaatcaccgattccgtcgccgttggaatcataaaagctcttcggataaatctgataggcaactttattgtgccaccattttctttccatagcgtgtatcctcctgatttttttatcaattttcgtttcgctcattacttatgcggataagtaatagtataatgacaaaaaatgattttgtcctacgaatatctgatgaaaaactacgttattttgacttgtgcgtttgtgaaaaagattttcgatactgcagaggtgtcattccggttttttttcggaattcttttaaaaaatttccgagattatgaaatccgcagtcaagacagatgtccataaccggacgctgggtatcctgaagcagagtaatggcacgcccaatgcggtattcattgatataggcgacaggagttttgccgatatattttttaaaaaatcggcagaaatactgttcatttaagccggcattttgagcaagggtatgcacataaaatttttcaccataatgctgatgaatgtaagcaagtgaatttttaataatttcaacccgataatcatcatccgtatgctcttttacggatagaagctgatattgttctaaaaaggcaaggatttttaataaaccggcacgaataaacagctgggaggctaaatcgtttgtgaccatctgatactcgttgattggagcaaatccattttgataaaacgcatttacaatttcaagatattcttgttttaatctggaaaaaacaggatgttccggtttaatacagcgtggaaaatagagctctcccttcatcatgggctgtaaaattcggctctgtgcgatatcataactgtcaaaatttaagattctcggatgaaaaacgacagctgattcttttacagaagtttttgctaaaatagaatggagttcaccagaatttacaaaataaaaacattcatctgtgatggtgtaaatattcatattgatgactaattcaaattcgccttccataaaataaagaatttcaagttcatcgtgccagtggtgtttgacaccgttccagttcttatcatcataagtctcataaagaccacagggaaaagaaaaggttccgtggtctttttgttcttttaaagtcgggtttgtgtttgacggctcagtcttttgcatgatacattccacctttctgctttgtaaaacacaataatccacttaaagtgataaacattgtagcaaattccgcagcgggaaatgccagccagatcccggtcattttaaagcaggcagaaagcacaaaggcaaagaaaatagttgcaacaaatccacgtgaaatagaggcacaaaaagcatatttaacggattctacagcacttaaggccgcagttccgacgatgttaattccagcaaataaaaatccgataaagtataatcttaagccagagtctgcataagcagcaagctgcaaatcgtgttcactgttaaagacagcggtgacagcaggtgcagaaaagaaaataaaaatcatcagtaaaacaccaagaccaagtgcagtggtgagagccatttttaaaagggagcggacattttgttcttctcctcgtccataggatcgactgataagcggctgagatccttgtgcaattccattaaacagtgcaacagcgaccaaagaagtattggcgacgactccataagcagcaacaccggtatttccggcaagatttaagataatcatattaaaggtaactgtaataacgcccgaagaaatttctccaacaaaggcagaaactccaacttgacaggaataaatcagctttttgatggacggcaggacaggaatcaatttaatcgtggatttcctggaaaaaaagtgaatacagcagattaaaattccgacaaccggagaaaaaccggtagcaagagctgcccctttcatagcaagaccgagaggaaacattaaaatgtagtcaaagacaatgttaaataaactgctgaataacgtagcagccatggcgatggatggatttttatcatttcgcacaaaagcgttgcagatatggttccacataaaaaatggggaaaaacacataaaaatccgtgtataggaagttccggtctgaatgatttcggcatcgccgccaagcagtgcaactaatttatccggaagaaaaatcccaataaagacaaaaattaagctgataaaaaatgcacagattagtgcatggaaaaagtatccgtctgcatccggattcttctttccacgttcaatcacaaagcggatagcagagcccactccaatcattgccccaattgcaaaaatgagattataaagtgggagtaccaggtttagggcggtgataccatttgaaccgactgcttttgaaataaaatacgtgtctgcgagaatataaagcgacatgccgagcataccaagcatattctgggagacatatttggtgaattgttttaacatagttttgaaatacctttcatttagatataattctaatagatatggtagcaaaaagtggcggattttgccagactttctttttaaaaacgcttatgctataatggataatcataaagattggagcaaaggcatgagtaaaaagagaagaaaaaaggcagaatgggaggcattatccgtaatttggtcctgattatcgcagccgcagtctttttattttctgcttatcaactggtcatgatttatttggagtataaaaaaggtacggatgaatatgataaaatcagacagtatgcggtagaaagtcctgtaaaagaagagacaaaagaaaatgatgaagcagaaggggaagaagagggggaagaggctcaagaggttcaagaacctcaaggaccacagattgattttgaagcgttaaaggcagtaaatcccgatgtggttggctggattgaaattgaaacactggatatcagttatccgattgtacagacgacagacaatgaccattaccttcattatacttttgaaggacagcgaaatgcgaatggtgcgattttcttagagcatacaaacagcagcgattttgaggactgtaataccattatttatggtcataatatgagaaatggctcgatgtttggtacatttcgcaagcttcatgagcagtcaaatctgacgagtccttatgtctggatttgtacaccaaaacatacctggcgttataaaatcttttcggttcatactgcgtcagtaacgggagaaacgtatactttattcagcatggcagatgaacagtttgccgagtatttaaaatctatgaagtcagcgtcagaattacaattagatgccgaagcagacaaagacgataaagtgattactatgtcaacttgtacgggaaacagcagtactcgttttgttattcaggcaaagcgccttgagaaaggagaaaattaaaatggataaaaaaattgaagcattgcagaaattaatttcagggcatcaaaatattgtgttctttggaggagcgggtgtttcaacagaaagtggaattccggatttcagaagtgtggatggcttatatcatcagaaatgggattatccgccggagacgattttaagccatactttttttgtaagaaagcccaaagagttttatcgcttttataaagagaagatgttatgcgagggtgcaaagccaaatgcagcacataaaaaactggcacagttagagaaagccgggaaattaaaagcagttattacacagaatattgataatctgcaccagatggcaggcagtaaaaaagtgtatgaattgcatggaagtgtgtatcgtaattattgtacaaaatgcggggcattttatgatttctcctatatgaaacatgcagaagggattccggtctgtaaaaaatgtggtggaattattaagccggacgttgtgctctatgaagaaggattagataatgaagtcatagaaggtgcagtccaggcaatcagagaggcagaagtgctgattatcggaggaacttctcttgcggtttatccggcagcttcgttgattgactattttaaaggagatgcactggttgtgattaatcgagataagacgccgagagataagatggcagatttggtcatcaatgaaccgattggaacggtatttgaacagattcgtgtagaataaagggagataaagtgatttggaacagagagaacggtaacagagtaacagaagaaaggaagagaaatggcatatcagtacgaagttggtgatattgtaaagttaaaaaaacagcatccgtgtggaagtaacgaatgggaaattcttcgagtgggagccgattttcgtttaaaatgcatgggatgtggacatcatattatgcttgcaagaaaacttgtagaaaaaaatacgagagatttgaaaaaaaatacttgattattcagaaaaagcatggtagaattaatcctcgtgatatatgattatccttgctctccaaaaagagtggagggccaaaagaccaaaaggaggtaaaacaggcatgaacaaatatgaattagcgttagttgttaatgcgaaaatcgaagatgaagctcgtgcagcagttgtggaaaaagcaaaaggctacatcgcccgttacaacggaaatgtaacagaagttgaagaatggggaaagaaaagattagcttacgaaatccagaaaatgcgcgaaggatattactacttcatccagttcgaagcagacgctgactgcccagcagaaatcgagcgtcacgttcgcattatggacaatgtattaagatatttagttgtaagaaaagacgcttaattttttcttagagcacaaaatgcgaatccccttagaattatagtgttttataattcccgattctatgtgctgctacgtacaatgtaaaaaatgttgaggtgaaagatatgaacaaagtaattttaatgggacgtttaacaagagacccggaggtaagatactctgcgggagaaaactcactggcgattgccagatatacactggctgttgacagacgtttcaagagagacggagaagcaactgctgattttatcagctgtgttgtatttggaaaacaggcagaatttgcagaaaaatattttcgtcagggaatccgtatcgtagtgagcggaagaatccagacaggaagctacacaaatcgtgatggtgtaaaagtttacacgacagaagttgttgtagaagaacaggaatttgcagagagcaaagcagtaagcgacagccacgtaaaccgtagtgcaagccagccggcagcaccggatatggcagattcctcagcagaaggatttatgaacattcctgatgaaatcggtggagaattaccgttttaagaacggaatatagcaggaggtagaaaccatggctttcgaaaaagggaatagaccggactctccaatgaagagaagaggcggacgcagaagaaaaaaagtttgtgtattctgtggaaaagaaaataacgaaatcagctacaaagatgcaaataaattaaaaagatatgtctctgaaagaggaaaaattcttccaagaagaatcacaggaaactgtgcaaaacatcagagagctcttactgtagaaatcaagagagcaagacacatggctattatgccatacgtacaggattaatttgctgtatcgaagccgtcacaaagtactgtggcggcttatttttttactttagttcaagagaatttacaaggaaaaataggtacagcacttccaagaagggaaaaaatttagagttatgaagtataatatattaataactgaggatgaaagagaaattgccgaattaatcaaactgtatctggaaaatgaaaattatagggtattttgtgcggaagatggaaaagaggcgttagaattcttagagcaggaatcaatagatatggcaatactcgatattatgatgccggggatggatggatatgaactgacgaaacagattcgtaaaagaagtaatatgccaattctgattttgtctgcgaaaacacaaagttgtgataaaataagaggcttaaatcttggggcagatgattatatgacaaaaccatttgacccgcttgaagttgtagcaagggtaaattcggcattgagacgtttttatcatttaaatggtgagccggaatccaaaaatgagaatcatattttaaaagtaggagatttggtgttagatacccagactcttgcactgaaaaagagagacgaagaagtttttctgacaccaatggaatataaaattcttgcattgtttatgaaaaatccagggatgatttttaccaaagttcagatttatgaaaatacctgtggggaatatgtcgaaagtgatgataatacaattatggtgcatatctcaaatcttcgggaaaagatagaggagaatcccaaaaatccacagtatattaaaaccattcgaggagtaggatataaaattgaaaaccgataaacgaaaaaagggcagttttttatcacttattatccggaattatctttggttttcgtttgctgtgctgctggctttgatgtgtattgttgttgtgattaactggatgggagaacagcatttttcagggttaaaaaccaaaaaaattaaaaaatttacggaatatctggaagaggggaattatgaaaaatttccatctgatattttgctgggacaaaaaggagcatttgttattttggatgaaaattttcaaatgatttatcaaagtaaaagtgacatgccaaaaagatttacagaggaagaattgttttttgtcaatgagttgggtatgaaagaaaagataaaagcaattttttatcaagatgaaaatgaaaacgaacggattttaatccaaagggaaaaaacaaaagagggtactgaaaagaacaaaaaagaatatctgcttttggataattctggaacagtattggtcaatcagatggggtttacaggaaagaatgtgaatcaaaaagagttggattatattataaaaaaggggaaaaatccggttcagtatgcaaagtgggaatttaaaaacaagcggggaaagagctatacagcagtttttcgctatgaaaaaaaagatgcaaagaaatatcttgaatttacaaaatccatgcgagtggttcagtggttgattcttccactttatgctctgattgtagcagtttttgccgtgcgtttgaatcataaggtgaaacgtccgctgatggcactgaaagaatcaattgtatgctatcagaaaggtcagaaattaagtaatgacaacaatggaccggatgaatttgtagaaatcggggacgattttgtaaaattggcacaaaggctggctgagagtgaagaacgaagaaaaatttctgatgaagaaaaacagcagatgcttgcagacatttctcatgacttaaagactccgattacgattatccaaggctatgcaaaggcaatctgtgatggtgtcataaaagaagaaaataaacagcagtatctacagacaatttatcataagtcaattgttttaaatgaattgattaatgcattttcagaatacagtaatttggagcatccggatttcagaccggtgaaaacaaaggtggatatctgtgaatatgcaagagaatatttagcgacaaaatataatgaattggtgttgggcggatttttgatagaagtagagataccggagatgataatctggtgtcagattgatgtacaacagatgaagcgggtatttgaaaatctgattaataactctgtcaaacataataaaagagggacaatgcttttcttttcgatgaaaaaagaagcagatacgatttgtatcagtatcggagataacggtacaggaattccaaaagagctagctcaaatggtatttgaaccgtttgtggtgggagatgaatcaagaaatagccggcagggaacaggtcttgggcttgcgatagcaaagaaaatagtggaggcgcatgacggagtgattgaacttgtaaaatttcccaaagaagggctttcaacagaatttcgaatctggatgcatacggataaggaataagaagcggtattgtacaaaaataaaaaaaatgatataataagccagtacatgcttatccggatgaatcgaaaataccggaaaatgttaagaaatcggaaggtaagaggatatgaatggcaatatcaagataaagggacagcttaagctgtatatgcagtggccggttatcatggtacttttactcctgcttatggatttgtgtattttccgcatcagtataaagggcggagtgattgcaacctgttttatagcggtgtatcttgcgatagcagtttttcagtatcataatagtcgggctgatatactcaatgagctgatttcttttgccacacagtatgggcaggtacagaaaagtctgttacgtgattttattgtaccttatgctttagtggatggcagaggaagaatcctgtggatgaatgaggcattttcacagttgagccagaaaccggtcaaataccacaggtcgattacaagcatttttcaggaaattacaattgaacgtctgccaaaggatgaatcttcagaggttctgtttcagtttgaaaacagagattacagagcttcgatgcgcaagatttcaattgaggcaatgttagaagattcaggtttgattgaatcggatgcagataattttctgacggcaatttatatttttgatgagacagatgtaaatcgttataaaaaagaacgcgatgaagagaaactggtaacaggacttttatatctggacaattatgaagaggcgttaaacagtgtggaagaagtccggcgttcgctcttagttgcgttgatagagagaaaattaaataaatatttctccgagatggatggtctggtgaaaaagttagaaaaagataagtttattctgattttatgccagcgttcgttagaagagttaaaagaaaaacggtttagcattctggaagaggtaaaaagcattaatatcggtaatgatatggatgtcacaatcagtattggaattggaattaatggggcaaattatgtccagaattatgagtattcgagaattgcaattgatttggcgcttggacgaggtggagaccaggttgtcataaaagaccgtgatactatgatttactttggtggaaagtcacagcagatgggcaagacaacacgagttaaagcgagagtcaaagcacatgccttaaaagagtttatggtagcgaaagataaagttgtggttatggggcacaagatttctgatgtggattcaatcggtgcgggaattggaatttaccgtgcagcgaaatctttgaataaacgggctcatatcgtagttaataatccaaccatgtcggtgcgtccgattattgaaaactttattaataatccggaatacgatgagcacatgtttgtaaacagtgcagaggcaaaagaaatcgtagataataatacggtagtcgtagtcgtagatacgaataaaccgagttatacggaatgtgaagacttattgtcaaagacaaaaacgatagtggtattagaccatcaccgtcagggtgcagaagttatttccaatgctgtactgtcttatattgagccgtttgcttcgtctgcctgcgagatggttgcagagattctgcaatatttttcagatggaattcgaatttataatatcgaagcggatgccctttatgcaggaattgtaattgatacggataacttcacttcaaaaacgggagtccgtacttttgaagcagctgcatttttacggcgctgtggcgcagatgtaacccgtgtaagaaaaatgttccgtgatgatgtcagctcttatcgggcaaaggcagagacagttcggacagtggaaacttacagggattcgtttgcaattggaatctgcccaagcagtggactggatagtccgactatcgtagcagcacaggctgcaaacgaactgttagatattgatagtataaaagcatcatttgtattgacggattataacaatttgatttatattagtgcaagggcaattgatgaggtaaatgttcagctgattatggaacggctgggaggtggcggtcatattaacgtggctggtgcacagttgaaagatgcaacggtaaatggagcaattattcaattgaaagatacaattgaccagatgattaaggaaggagcaatttaagatgaaagtaattttaattgaagatgtaaaatctcttggaaaaaaaggaacaattgtaaatgtaagtgatggatatgcaagaaatatgctgtttccaaaaaaacttggattagaggcaaccccaaagaatattaatgatttaaaacttcagaaagcacacgaagaaaaagtggcaaaagaagtattcgaagaagcaaaagcgtttaaagaagaattagagacaaaagaaatcacagttggattaaaagtaggagaaaacggacgtacctttggatctgtttccacaaaagagcttgcagaagcagtgaaatcacagttgggatacgacattgataagaagaaaatgcagctttcttctcagattaaagagttgggtgtagtaagagtaccgattcgtctgcatccaaaagtaacagcagaattaaaagtcaacatcaaagaaatgaaataagatacgcttagaaaggagccatgactggcatggacgaagcactcataaagagaatacttcctcataatacagaggcagaacagtcggtaatcggctccatgattatgaataaagatgcgattgtgacagcatctgaaattattacaggcgaagatttttatcaacagcagtatggaattgtatttgatacgatggtggaacttttcaatgaggggaaaccggttgatttgattactcttcaggatcgtttgatggaaaaagatctgccgccggaagtatcaagtatggaatttgtcgcagaattaatgagttctttgcctacatctgtcaatgcaaagacctatgcggagattgtaaaagaaaaatcgatgctccgtaagatgataaagacgatggaggaaatcacaaatacctgttatctgggaaaagaacgggtgcaggatattatggaggataccgaaaagaagatttttgatttggttcaaagaaagagcaatgaggaatttgttccgattcgacaggttgtcttaaatgcgattgaaaaaatagaaaagtcttcgagaacaaaaggcagtgtaacgggaattccgacaggatttgttgatttggattaccagatgtccggttttcagccgtccgatttgattttagtggcggcacgtccatctatgggtaaaactgcgtttgtattaaatattgcccagtatatggcatttcggaaggatgtcacggttgcaattttcagtttggaaatgtcaaaggaacagttggttaaccgtctgctgtctcttgagtcaaaagtagattctcagaatatccgtacaggtaatcttgaggatgaagaatgggcaaaactgattgaaggtgcaaatattattggttcttccaatatgattatagatgatactcccggtatctcaatatcagaactgcgttcaaagtgcagaaaatataagctggaacataatcttggaattatctttattgactatttacagttaatgacgggcagtggaaagagaagtgaatcaagacaacaggaaatttccgatatttcccgttcattaaaagcattagcgagggagctgaatgtgccggtagttgcactgtctcagcttagccgtgccgtggaacagcgtccagaccatcgaccaatgctctcggatttgcgagaatccggagcgattgagcaggatgccgatgttgttatgtttatttatcgtgatgattattacaataaagattcagagaataaaaacatagcagaaatcattatcgcaaaacagagaaatggtccgattggaacgattaatctggtatggctgccgaactatacaaagtttgtaaatatgaaaaaataaaatgatgtaagtgtcaaaagtataaattgcggttgtgcttgcacaaagagcaatttatacttaattgacacgccgagcaccgaaaacgaaataaaatggtgtgaatacgccattttacgagagtttgaggtgttcgaggattgcgagaattgcatagcaatggagcaatccggttacatcagtgagtgacaaaatttacttttgacactcacatcataggataaaaaactgcggagcttttttagttccgcagtttttttgcaagcatttcaggattggacgcatgattgagtgcttcctgacggtcgatgactccttgttggtaaagtcgtaataaactgttatccatcgataacattccgttcgcagaagaagaatagattaagccgtcaatctgatgaactttattatctcgtatcatatttttaattgccggagtggtattcataatctcaaaagctggtgttaaacctccggtcagatctggaacaagctgttgggagacaactgcctgaagcacagaagaaagctgaacggcaatctgtctttgctggcttggcggaaatacatcaatgattcggtcaatagtatttgcagcacctaacgtatgaagggtagaaaagaccagatgtccggtttcggcagccgtcatggcaacagccattgtctcgtgatctcgcatttctccaagcagaataacgtctgggctctgtctgagagaagcacgcagggcagtgatataattttctgtatccgtacaaatttcacgctgacttacgatgcttttcttatggctgtgaagaaattcaagagggtcttcaagagtaataatatgcttttccattgtgctgttaattgcatcaatgatacaggcaagcgtggtggattttccacttcctgcaggacctgtgacaagaaccagccctttgttatgagttccaagatcaatgatttccggtgggattccaaggtcagacggatttggaaggtggaaggtgataacccggatgacggctgccatggaacttctctgcatataggtgttgacacgaaagcgggaaagaccggagactgcaaaggaaaaatcatcatctccggtttttaaaaaatgggaaatatcacggtttccggcaaggctataaatctcacgaatcaatatttcagtattttccggcatgatacgttcagaagtcaattccattaactgaccgctttttttataagaaagaggaagtcctgctacaatgaaaaggtcagaagctccaagttctgttgtcttttttaaaaaagtaagtgcatccatgtttatattcctttcttggattagttatctccggtgtagacaggcagggtatcatcggcttcccatgtctgtgcgttgatcagtttccaggtctctatctgatagaaagagtccccttttttgatttcagaatttaaaagaagcaccacctgcagaatttgatgttcatttactttgatttcataagcaatctggtctttggatggaaaggagattccatcaaggctggttaaattctgctgtacctgtttaagatagtcggaagaatcggaggattgataggtggatttaagaatagaatcaattttatccattaattcgttcgctgaattttcagcttcatagacttcatgagtatgagcgctgttttttttcaccagcttatagtctgcatttgcactgacaagggaaagcactgcgaaagtcagcagacataaaataacgaagatcaataagatagaagaaattccaattccaataggaagctgatgtttgtctttcattaagagttctcctttttttcatctgcggtgcggggaatggcagtttttaaatcaagtgtatcgatagaagctccgtctgcatcttttaatacaatagaataatggttcaaatgaccgtttgtctcttttataatagtcagatagtaagtggcattattagaagaaacagcagttccattttcatcataagcaatctgccatccgtctttggtttctttcgctttcggaaataattcttcaaaaggagtatttgtattagaagtatccatataggagagtgcttctgcgacagaagagacaagagtagaaccaagagactcttcttttgcttctttgctggttaagtgtgcttttacaaatacctgaacgcagagcatactggtaagagaaaaaaagaaaataacaaaaatcagctcgagtaaaaaaaggctggactgtgaagcgtttcttttattcatgatgctcctccttttgtgtcggtcgaatgactgcggatatgaataagaagagaggcggaagtattttcttcgtccgttacggtaaagcgcagtaaattttcgcccgcttgttcaatggaaaaattttgtatggctaaaatcttttctccttgtgatttttttacaggttgtgaggcttgtacaaacagctcttttaaggcattttcatcttcataaatataagtaatgtaagaaacgccgccaatggattcagaaagttcaagggcaggagcatcttcaagagttccaagggagattgaagatgtcgaatcatgttggcggactttttcagcaacataggtaagagccgtacgagtcgtatagtttgttttcatatcaagtgctgtctgtttataaacatgtgctccgattaagagaacggtcaaagaagagatggtaaacagacatagaagcccaagggagaaaagcaggtctgtaatatgcacttgttcatggaagcgcctttttttacttattttacgcatggcagttcccccttgtttgtcagaataatgacatcaatatccggcatcaggttagaagcatgaacctcatagcttataagatattttgaatgatcataagtgattccataatggttctccagataagaaagactttccggataagctccttccacggcataacagtaaatggtactgcggataacagcctgttttaagttctctatttcttcttgttttgtagtagctgagatagaagagacaggaagaagaaacagaaaaaaaacggcaaaaaagacaacaactggaacaagaatcgaaaggacactttttgaaattggtttttgctgtgtaaaacgattcataataaaaactccttttggataataggtgctttcagccacaaaagcaaggataataaaaattccgagcgtacatgaatcagcccattccggacataattcccataagaggaagcataacagataaaagaatcaatcctacaataatcgaaaggacggcaacgagagttggttctaatttgctgattaattgaaagatgcgttcatttatatcttccgaatattggagggaaatctgtttcatgaccatgtctactgcacctgttttacaaccgatagaaatcatgcgggttgaaagcgaatcgaaaatctgactttcggaaactgcttcggaaaaaccttgtccctcttcaagcagggcacgtgttttggctattttttcttctaataccggatggtcggcaagacgggcagccatttcaagactttcatcggtatccagaccgctttcaagtgccagatacattccacttgcaaatcgggaaacagcaattttttcagagaatttttgagtaaacggcagtttggagctaaatctgaaaaattggttccggcctttttctgtaaatgtaaaatacaggaaacatcccgcaagtacgcctgcaagaaggacaagaacaaaggcataacggttcatcaggattcccaggtttaaaatatttttggaaacaccggttaagcctgttccaagctgttcataaacctggttgaagacaggcataactttgacaatcaaaacaagaataactgcaagcatcatggtaatcataataaatggataagtaatggcatttttgatactgcgggagatggtttcctgctgttcataatgttcagagagtgcagacataacttcatcgagtcgtccgctctcttctccgatttgtatcatattgcacatatattccggaaacactttggtatctcgaattgactgatgaaaaataccggtttcttccatattggaaatcagtgattctaataattcttttccctgttcggggctgtcctctgccatcagggaaagtccttcggtagaagaaatgccggaatgaagaatcattgacatctgcccacagaacatagaaagttcattgttggataaaggcttcataattaatatggctcctttcgtaaagtaaaataggataaggatagcagagtaagattaacgagtatatcgtgtcacataattgtctccatcgccaatatagtttaaaatttttttactgttagcatttgcagaggcaaaggttggatccattcgttcccagtgtttgccgtcaaattggatgatatcgtcaatccatcctgtttcctcaagatagacactaatccaggcatgataaactttgcctgcatagccaatttgaagctttgttgggattccctgagagcgaagcattgaggtcattaatgcggcgtaatcaaaacaaattcctttttgggtttccagagttttatcgacatccggcagatatccgttttggaccgtttctgctttttttgtatcataagtgatgttgttgatcacataatgatagatagaagaaaccgcatcgagatctgaagtggcattttttacgatatcagaagctttggatacaatcttgctttctttggaaaaattcacatactggtttggataaagataaggaacataatcattttccagagtgacttcaatgttttcagtataaagagaagcatactgtgttccggaaatattttcataagtcttgacggtataggtgccgttaccgcttgtaatcggcagggttacatatccatcttccggttttatgaaatatttatattcaatttcatccggtccaattaactggatatttgctttttcggatgttcccgaatagtaagccatcacatagccctggtccaaatgggatatgtcaattaacaaaggctcttgtccgattacagaggtaccggaggcttttggaatatgtaaatccggtttatttggacggacagtttttgaggaagaagaattttcctttgttgtaccagaagaagatttgccggaagagcaagcagtcagaggaaataaaacccataagagattaaaaaaaagaagaaagaataaaaccttatggtatttataaaacataagaaaaactccttaatctgaggtaaaatctgaggttaaaatcttgtaattatcatagcattttttaaagataagtgcaatgataagcaaaagtaaccaaaaactgtaaaaagttattaaaaaacttgaaggattagatattgtattctctcaaaaaattcgataaaataatggatatgcatacggggaccttatagcggaagctgtaaaggagtgatgcaatgaaaaaaataataaaattaaaaaataaatatggtatgattgtgtgtgtgttgttttgtgtgatttatttttgtcttggatgcggacaggaagatgagacggtatttttggagcaaaaagaggaactttcagaagagacagaaaaaacgaacgagacggaagtggaaaaggaatcaaagccaaaagagtcagaagaatctgaaacagaagaccgggaaaccaaaagtgccggtcaggaacagatttgtgtttttgtctgtggatttgtaagaaatccaggggtctattatttgaatataaatgccagactttatgaagcggtagaagcagcaggaggttttttggaagaagccgatgccggatggcttaatcaggctgagattttgtcagatggagataaggttcggatttattcaaaagaggaaacacaaaaaatgcaggaagccggaatgaaagaggaaagcgggacagcagagaaaagtgtggaaacgaatcagcaaaatcagacacaagatgcaggaaaggtaaatatcaatactgcatctgcagaggaacttcagacgatacccggaattggagcggcaaaggcagctgcgatcattgaatacagggaagtgcagggggagtttaaaagcacagaagagatacagaatgtaccaggaatcaaggggaaaacctttgaaaaaatacagccttatctaacggcaggatgaaaaaaaagcaaggagagaatcgatgagtaaaaaagtattggtagtagatgatgaaaaactgattgtaaaagggatccgtttcagtctggaacaggaaggaatggaagtagattgtgcttatgatggagaagaagcgttaaataaagcaaaagaaaatcagtatgatatgattctccttgatatcatgctccctaaaatgaccggtcttgaagtgtgtcagcagattcgggaattttcttctgttccgattattatgctgaccgcaaagggagaggatatggacaagattttaggtcttgaatatggagcagatgactatattaccaaaccatttaatatccttgaggtaaaagcacgtatcaaagcaatcatgcgaagaacgcagaaagaaaaaaaacaagaagaacgctcgaatacattagaggcaggtgacatgcgtttagactgcgaaggtcgtagaatttttattgccggaaaagaaattaatctgactgcaaaagagtttgatgtgttagaattgcttgtaaaaaatccaaacaaagtttacagtagagaaaatctgttaaatcttgtatggggatatgaatatccgggagatgtgcgcacagtggatgtacatattcggagacttcgtgaaaaaattgaaacaactccaagtaatcctaaatatgtgcatacaaaatggggagtcggctattattttcaactgacaaaataaattttgacgagggcataagacgtgaaggaaaaaataaaatttactttttttaagagtttaagattccggattatggtgattttagtggtaatcggaattgtcccaagttttattgtaaaaaatgtagttgtaaatagttacgagacaagagcagtttccatacgggaagtcaatctcaaaaatcagtgtgatattctgggaaatcagctgatgaaagaaaattatttaagagagccggattccgatgtgatcaatggagaactttcgatgttgtcggcaatctataatggtcggattcttattattaataaggatgcaaaaattattaaagatacctatgatattgatgtcggaaaatacgcactttcagaagaagtcattcaatgttttgaagggaagagtacggcaaattatgatgataaaaatgcttatatagagatgacaagtccaatcaccaagatggattccaatacaatcgaaggtgtaatgctagtcagtatctctaccagtgaaattgaggacagtatcgatatgctggaaaacaggggaaatcttctgcttagtattatctgtattttggtactggtttttggatacctgttggcaggagttttagtaaaaccgttctcaagagttacaaaagcaatcgaagatttgacagacggttatctggatgaagaaatttctgttccggattatacggagaccgagctgattacaaatgcatttaataagatgcttggccggatgaaaacacttgatgaatcccgtcaggagtttgtatccaatgtgtctcatgagttaaagacaccgatgacttctataaaagtacttgcggattctttagtgggacaggagaatgtaccggtagagttgtatcaggagtttatgcaggatatcacagtagaaatcgatcgtgaaaacaagattattacggatttattatctttggttaaactggataaaaaagcagcagacttaaatattgccgaagttgatattaatgaaatgcttgaaaatattttaaaacggttaaatccaattgcttctgtcaagcatgtggaacttgtgttagaaagttttcgtccggttgtggcagaaatcgatgaagtgaaattaagtctggcattttctaatttaattgaaaatggaatcaaatacaatgtagaaaatggatatgtgcatgtcaaacttgacgcagaccataaatatttctttgtaactgtaacagattcgggaatcggtattccggatgaaagcattgacaagatttttgaacgtttttatcgagtcgataaatcacattccagagaaatcggcggaacgggtcttgggcttgccattacaagaagtgcaattgtaatgcatagaggtgcaattaaagtaaaaagtgaagaacataaaggaacaacgttttcggtaagaattccgttgacgtatatcgcgtaaggaggcagaagcatgaaaaaaatgcggatggcaggactcttttttctgatagtctgtatgttgactgcttgtggcacaaagaaaacggaagaaaaaacagagtacaaaatgtattatctttccgcagcagaaacttctcttgaagaggaaatctatacaccgacaaagacagaaacaaaagacattgtagaggaaatctgtgaaaaactgaccgagacgaatccagataatgatcatcttcgtctgcttcccaaaaaagtggaaattcttgactgtgagtataagaatggaacagtctgcatcgacttcaataaagaatataagaaaatgaaaaacaccagagaaattctggtgcgggcaggaattgtgaaagtttttactcaattacaggcggtttctggggttacgtttgaagtagaaggagaaccacttttagattccaatggagaagaagtgggaactttggggaaggattcctttattgaaaatgagggaagaaatattaatacctatctatatacagaacagacgttatactttgccaataaagatggagataaactggtgaaacagcaggtaagccggcattacagcagtaatgttccgcttgaaaaagcaattgtggaatggctgattaaaggtccgacaaattctgatgcgcaggcaacgatttctccgtctactaaaattttgggtgtttcaattgtagaaggagtctgctatgtcaatttggataaaacatttttaagtgacccgatgaatatacaggaaaaacttccaatttattcgattgtcaattctttgatggatgcctgtaaaattcatggggtgcagatatcggtagaaggtgagacaaaagtaacatttcgggaaagtatgaatctggataaactatataaagcagattatagtttagtagaagatgaggagaccattgatgagtaggagaccgttgtgcatcataggatgtctggtcatactgattttatggagtttaaatctgatgggagtttccacttttggtggaacttctttggatttaaccgattctgaccgttcagtaatcatacaaggcatcctatataaacaggaatcaaattctttttatacaagtctatatttaaaaaaaacaaatctgattcaaaattcaaaaaaacaatccattgataatgtaaaagcaacaatcaaaacagaatatttaaaacaacttccttcagatggtgacagacttttaatacaggggagattaaagcagatccaagaaccgggaaatccggggcagtttaatgaacgaagctattattatgcacgaaaaataaaatggtatctggaggcagaacaggtaacaattcaaaaaacagaggcagataagggtgtcacattcagaagtcggttaaaagagttattaaaaacaaaaattaagcagattaccacaaaaaagacaagtggtcttttcatggcgatattgcttggagaaaagtcagaagtagagagagaaacgttattgcggatgcagttaagtgctatgtcacactgtgttgtggtatcaggaactcatctttcaattttaggctggggtttgtttcgtttgcttagaaaattaagaattccgctttggatggcaggaatgatcagtatttttctgatgatacagtatggaattttcacaggaaacggggcgtcagccgtacgtgccgtgattatgttttctatggctgtgggagctgtgcttgtgggaagaacgtatgacctgctttctgcgctggcactttctatcttactgcttttatcagataatcccaaatggctgacagacagtggttttttactttcatttggtgcagtcattggtctaagtattttttatccgaaattaaaaagtaagaaagaaaacaaacttggaaatacatttttgggaagcatagctgttctgcttgtcaccctgcccattcaaatgtatgcgttttatgaaattccgctttttggaattttggtaaatctttttgttctgcctacaattggaatcgttttgataagtggaatggcaggttgtgtagctgcatttttttctctttttcttgggaaaattctggcttttcctgcaattcttattttaaatttttatttaaaaatcgggaaagtgatacaaagtattccacaggcgacgtatattacaggaagcgtttctcttaaaagagcagtagtttattatggaatactggcaggttggtgctttttaagaaagaaaagtaaaaaagttccaagggttggtctgattctggcagttttggttttactgtttccgactccccgaaatcagacaaagattacatttttagatgtgggacagggagactgtgcagtgattcagcaaaagaaagaagtctatctgatagatggaggaagcagtgatgtatcaaaagtgggaacctatcggattttgccatttttaaaatatagtggaatccgaacagtagatggaatttttttatcgcatccagataatgaccatatcaatggaattgaggaactgtttgaggcagttgccaaaaaagagaccagtctaaagatagaaacggtttatctttcaaaaaataaagaaaaagaagagaaaatcaatgaaatcgcacaacttgcaaagcgtgcaggctgtgaggtgcgttacataaaaaagggggcacagttaaaacaaaaggcatttcaggtagaatgtctttctcctgagaatgagacgggagaaagcaatgaaaattcccaggttctgctttttaaaacagataatttaagtgtgctatttaccggagatatggaacaaaagggagaagatgcagtgacagaacagttaaatgaaaggcaggaacagattgatattttaaaagtaccacatcatggctcaaaaaattcagcaaaggaggcatttttagaggctgcaggtgcaaagattggaatcatttcctgtggagaaggaaactcttatgggcatcctcacaaagaattgttggaacggctgaaggaaaagcagatagggtggtatgtgaccatagaaagaggagcgattaccgttacagcgggaaaaagaaataaactttctttctataaaaaatgaagtgtgatagaatagatgaaaagagcacacaagaaagaaatagaggaataatattattatgaagagtttgcaggaagacatcaggcagaaagagtttaaaaatgtctatcttttttatggagaagaagcgtatttaaaacaggtatataaaaaaagaatgaaagaggcattgcttcccgatggagatgaaatgaattttactttttttgagggaaaaaagacagaaccgcaggaagtgattcagatggcacagactatgcccttttttgcagaaagacgagtgatttttcttgagaataccggattttttaaaggtcagtgtgagagtcttcccgagtatctgtcacagcctcccgagtatctgtgtatgatatttatagaggaagaagtagataaacgaagccgaatgtataaggcagtaaaaaaatccggaaggattgtagagtttgcaaaacaggattcagatatgctgattcgctggatatttggaattttaaataaagaacagaaaaagattacaagaaacgatatggaactgtttttaacaaaaaccggcacggatatgggaaatattgaaaaagagctggaaaaactgctttgttatgtcttagaacgagatgtgattacaagagccgatattgaagctgtctgcacctcacaggtttcgaatcatattttcgatatgcttcgtgcggtgacagagaaaaaacaacagagggcactggatttgtattatgatttacttgccttaaaagaaccaccgatgcgtattttatatctgctggcaagacagttcaaccaaatgcttcaggtaaaggagcttgagaaagagggatatgaccagagtgcaatttcaaagcgtctgggaatccagccgtttgtcgtaaaaaattatcagaagattttaggacggtactccttagaacagttaaaatcagcagtggaaaaatgcaccaaaaccgaagagcaggtcaaaacaggatatttaaatgatgccttaagcgtggaactgcttttagttgaattcagcagttaaaatactcgccaagagggcttgacaaggtgcctgtgcaatgatatcatcttaatgatacgagatgtagatagaggttgcatttttcatgagtagatggttggatgttcaggagcagatgaaggcttttgaaagggaaagatgccgaaaaaatacaagacctgagcttgtgtttttgggcatgtcattaagagtggcatgactgtcatcgcaggatggagtgctatctgatagatatgaaacggatatctggagacggcgcatcttgccgtctcttttttagttaatcattcaaggaggaaaagatatggcaatttttaaaggcgcaggtgttgcaattgttacaccaatgaaagacaacttagaggtaaattatgataaactggatgagattttagaggaacagattgcaggaaaaacagattccatcgtaatttgtggaacaacaggagaatccgcaacactctccgaagaagaacacttagaagcaattcgttttactattgaacgtgtcaatcacagaattcctgttgttgcaggtactggttcaaattgtactcagactgcaattcagatgagtaaagaagcagaagaagcaggagcagacggagtgcttttagtaacaccttactataataaagcaactcagaatggtctgattgcacattatacagcaatcgcaaacgaaattaaaattccggcaattctttataatgtaccaagccgtacaggatgcgcacttcagccaaaaacaattgctcatctggtaaaaaatgtagaaaacattgtaggtgtcaaagaagcatccggagatatcagccatgtggcacaggttatgaatttgtgtgacggacagattgatttatattccggaaatgatgaccaggttgtaccgctgttatctttaggaggactgggagttatctctgtactttctaacgtagcaccacagtatgtacatgatatggtttacaaattctttgaaggggatgttgcaggaagccgtaaaatgcaattagaggcacttccggttatcaatgcgttattctgcgaagtaaacccgattccggtaaaagctgcaatgaatctgcagggaaaagaagttggaccgcttcgtgcaccgctgactgagatggaaccggagcaccaggaagtactcaaaaaagcaatgaaagagttaggaattttataaaataaacagaagaatccgctataagatacgaaaacaaacgttcttatagcggattttttgcatttttttagaggaaaatgacaggggaaactgtggattttaagaaatgtttagttgcctttttgttaattttatagtattataatttagaaatttaatgaattagcaaaaaatttaatgaattagaaataaaagaatagaaggtggttagaccttgataaaggaaaatcagaagcattttaaccggctgcatgtggtgattgatgcttttgtgattattatttcttattttttggcatggcttttaaagtttcatctgccgattttaagagatgagggcggacggcttccatttcatatctatatgagtgcgctgttatttattgtaccagcttatcttatgttgtattatgcatttagtttgtatacgccaaaacgagtacaaggaagaagacttgaattttcaaatatatttaaggcaaatacattaggattgtttctgttgattacagggttgtatctaattaagcagattgacttttcccgtcatgtaattgttattttttatgcaattaatgtcgtgtcagaagagttgactcgaatgctgattcgggttgtacttcgcaagatgcgcgcaaaaggttataatcagaaacatattttactggtgggctacagcagagcgtgtgaagaatatattgaccggattcttgcaaatcctcagtggggatatacgattcgtggaattttagatgataatgtacaggcagggtatatgtatcgtggaattaaagtgcttggacggattgataatctgatggtgattctcccgcagaatcatttggatgagattgcgattacactgggattgagcgaatattttcgattagaacagattgttgcgttgtgtgagaaatccggagtgcatacaaaatttataccagattataatcgaattataccgacaaaaccttataccgaagatattttaggtcttccggttattaatattcgttatgtacctcttaccaatacatttaatgcctttacaaaacgggtaatggatattgtaggagcgtgtgttgcaattatattattttcaccagtcatgctgttttcggtgattatgataaaactaacttctccgggacctttgatttataaacaggaaagagtcggacttcataaccatagttttctgatgtataaatttcgttccatggaagtacagcctccggaagaagagaaaaaagcatggaccgtaaaaaatgacccgagggttacaaatttcggtcggtttatgagaaagacaagcattgatgagctccctcagctttttaatgtgttaaaaggtgagatgagccttgtaggtccgcgtccggaacgtccattttttgtggataaatttcgggaagaaattccgcgttatatgattaagcatcaggtgcgtccgggattgaccggatgggcacaggtcaatggataccgtggaaatacttcgattcgcaaaagaattgagtatgatttatattatattgaaaactggacgttaggtctggatatcaagattttgatactcacattttttaaaggatttatcaataaaaatgcatactaaatacaataaggggaaataagatggcaaagagaagcagaaatactgtaaaacgcaaaagaagacgactaatatttggaattgaactggttgtactactggttttagtcggtgtgctttttgtatatgcgaatattacaaataaacttggcaaaattgatatttcagacagtgcaggcagtgcagatgtcaaagtcaatgagcaggtagtaggcagcaaagtcatgaaaggctatacgaatattgcgttgtttggagtggattcccgagatgaaaatctggatagttccaacagtgatacgacaattgtagcaagtatcaacaatgatacaaaagaagtaaaactggtttctatttatcgtgatacatacttaaatattggacaggataaagataaatatgacaaagcgaatgctgcttacgcaatcggtggaccggttcagtcaatgtctatgttgaacacaaacatggatttaaatattaaaaattatgtggcagttgactttaatgcgttagtgaaagttattgatttacttggcgggttggatgtggatctgtcttatgaagaaattgaacatatgaataactattgtgtagagacttctgaaaaaaccggggcaagttatgagccgattgaaaaaccggatccaaaaccggaagatgaatcaaaaattttaggaacttatcatttaaacggtgtacaggcaacttcttactgtcgaatccgttataccagtggatgggatatgaaacgtaccgaacgtcagagatatattatttctctgatggtggaaaaagcaaaaaaagcaagtctttctaccttaaatgatattatggatgaagtatttccgatgattaaaacgaacttctccaagaccgaattgattcagcttggaatgggtatcctttcttatcagttaggagatacacagggcttcccgaagagtaatatcatgggagaagatgtaaaagatgcaattggaattgattgtgttgttccaacgacccttgaagcaaacgtcaaacaattacatgcattcttatttgaccaggaggattacagcccttctgagactgttttaaaaagaagtgactatattgcagctcataccggatttggaaatgattatgtttcggatgaattaaaacagtatatttcagacagagaatctgcattggatgatgaggaaaattctgacagcgaagaagagatagatacacagtccgatgcaagcagtgagacttcagcagatgatatgtcagcttacagtcaggattcttcaagttcggataattatagtaatggcaattcaaatcataatgattatgattatgatgacagcgattatgattatgaagataacagtgacgactatagtggatatggcaataataatggctattataatagttataacgaggataacagtgatggtgatgagtccggcagttataattctgaagaaagtgatgatagtgacaacagctacagtgatgataatacctatagtgaagaggaagaataaaaaagaatctgattttgcagattctcaaaggggatgtcgtttaacgacatccccttttctaggctggaaaatgcgcataaaatttttcttatatccagtgtaaggacagagtctgctgaaactcaatgtttgctagatcagttgacaataaaaataaaagataagaggaataaaacaaaatgagagatttatttgaaaatggaaagaagccggaagtatctgtgattataccggcatacagaccaggaataaaatttgagcgtctgctgaaaaaaattcagaagcagagttatccggtaaaagagattattgtaatgaacacagaaaaaaaatattggaacatggattgggagtttgtaaatccaaatttgaaagtgtatcatattaaaaaatcagagtttgaccatggaaagaccagagcagaagcagtgaaattaagtaccggtgatattatggtgctctttacacaagatgcagtgccggtcgatgaatttgtaatcgaaaatctggtaaaggcatttcgaaataccaaagttggagtagcttatggacgtcagcttccaaatccggaatgtgccttgattgagcgttataccagagcatttaattatccggataaaagcagattaaaaggaaaagcagatttggatgagttgggaattaagacatttttttgttctaatgtctgtgcagcctatcgaaaagacttatatatgaagatgggcggatttattacgcatacaatttttaatgaagatatgatttatgccgggaaaattgtactaaaaggctatctggtagcatatcagtcggatgcaagagtgtttcattctcacaattatggaaatgtggaacagtttaaaagaaattttgatttggcagtctcacaggcagaccatcctgaaatttttggaaccgtgaagtctgagaaagagggaatttgtctggtaaaaaatacagcccgttatttgtgtaaaattcataagccatggctggttgttgacctggtgataaagagtggatttaaatttttagggtatcgcaccggaaaaatctataaacgtctgcctaagaaagtaattttagcgtgtacaatgaatccatcctattggagaaagtaaaataattttttaaaatctatgatttttatcacattttggacacaattccctgttaaactgtgctcataaagaaaaaagggagtaattactatgagtgaagaattcaagaatgaatttgatgaaaataaagaaacagagacagataatgtaaatacgcaggaagaaacagagactgtttttgaagataatgcgtctaagccggaagaaacaacaaatgaaagtgcagtgacacaagaaccgggaaatgcgccaacaccggaaaatccggtttatgcaagagcataccagccgcatgaacagcgggaggccacaaaagaagagtggtatcaggaagcacagcaggaacagaaacagcagcaaagttataatgcttatcagtttactgctccggaatcaaagaagccaaacagatccggaaagaagttaaacggacaaggcagaaaatttggcacagtcgttgcgacagcggttgtgtttggtctggttgcaagtgcagtttttcaggggacaaattatgtgggaagtaaattaaatccacagggaaaaaaatctgttcaggtacagtctacacagacaatcagtcaaaataaatcatctgattcagaagaaagtgtatcaggaagcactgagggaacttcaagcgtaagtcaggttgcccaaaatgcaatgccgtcaattgtatcgattgtaggagtcagcgttcaggagattccacagatttatcagtactttggatatggacaacagcaggaaactcagagcagtggttctggaattattgtaggacaaaatgataccgagcttttgattgcaacaaataatcatgtagtcagcggaacaaattctcttaccgtgtgcttcacaaatcaggacggaagtgcagtaaccggaaatggtgacgtggaaaagaccagtgccgaaggtgaaagcggcagcacaaatcaggatggtcaggacagcagtttggatgatgttcaaagcggtgcggtatctgcacagattaaaggtacggatgcagataatgatcttgctgttatttcagtaaaattggaggatattccggaagatgtattaagtgagattaaagtggcaacaattggagattctgattcccttcagatgggtgaacaggttgttgcaattggaaatgcacttggatatggtcaatcagtgacaagtggttatgtcagtgcattaaaccgtcaggtaagttcagatgatacagatggaacttttattcagactgatgcagcaattaaccctggaaacagtggtggtgcacttttgaatatgaaaggtgaactgattggtattaactctgcaaagattgcttctgatgaagtggaagggatgggatttgcgattccgatttcaaaggcagaaccaatccttgatgagatgatgaatcaggaaacccgttacaaagtagaagatgaagataaagcagcatatattggaattacctgtgaaaatgtaaccagtgatgtcaaccagatgtatggaatccctcagggagtttatgtagatactgtagtagaaggtggaccggcagaaaaagcaggaatcaaaaaaggtgatgtcattactaagattgatggtactgcgattgatgcatacaaagatttggtagacagactggaatactatgaagccggagaaaccgtagaattagaagtttaccgtgcacaggatggagaatataacgctcagaaaatcagtgtgactttaggagcaaagaaaaatgcgccgagcacaaattcttcttctaatcagcagcaaaatgaaaaaaataataaatagtaaaaagagatatcagaataccgtaggaatgttgtttgttcctgcggtatttttttgataagttccaagaaaagtcaaatgccttaccatgcaaacatgaaagtcatttgaactttctgacccttggtatcataatataatactgtatcttttattttcagggattattattatggaaagatattgtatgcaaaatcattatacttgccgttcaaacaggatgtcagagaatcgttctatgcaaaaccgtccgtttagtggggactgctttgatgatactgctatttataaacatgcagaccatctgcctcttacaatggcttatgttccgatgcagaaattctctggaacattttctcttcagaagagtctgtcttgtggaactgtttttccggagctttgtaaaccattttgtggaaagagaggtcgttgcagatgaatcagtgtcgagaacaaactgccctgcttcaatatatcaatgaagttagttttgcaatcaatgatatgaatttgtatttagatacgcatccagaagataagaaggcattggcatttatggaagagcacgtaaaaatgcgcaaacgtgcgttaaaagaatatgctatgaaatacggaccacttacaattgatacgaccgatgacggacagagctgttcatgggactgggtgatgcagccctggccatgggaataatcaaattggaataaagaaaaagagtagaaaggaaagtatttgttatgtggaattatgaaaaacggcttcagtttccggttaatattaaaacgccaaatgcgaaactggcgttatttatcatgagccaatacggtggcccggacggtgaaatcggagcatccatgcgttatctttctcagcgttttaccatgccaaaccgtattgcaatgggaacgttaaacgatatcggtacggaggaacttgcacaccttgagattgtttctacaatcgtgcatcagctgaccagaaacctttctatggaagagattgaacagtcgggtcttggaccatattatatcgaccataccgtgggaatctggcctcaggcagcaggaggtattccatttaatgcctgtgagtttcagtcaaagggcgatccgattacggatttatttgaagatttggcagcagaacaaaaagcaaggagtacttatgataatatcctgcgtgtcgtaaaagattctgaagtagcagagccgattcgtttcctgcgtgcaagagaaattgtgcatttccagcgttttggtgaagcacttcgttcagtacaggaagaattggattcgaggaatttttatgcatttaatccaagttttgatgcaccttgccaggccttttgcgaatctatgacaaagaatgggaattaagtcaaacgtaaaataatttgacaattgattatgattctgttatcatagttttcgctgactaagttttgtgagatgccacaataagcattacgagcgcttactgtggcatctatttttctgtcaattcatagaaaagcaggtgaaaaagtcttgagattgtttctattgttatttctattgattcacagatgcctactaatagaaaggaaatttatatatggaaaccattacatttgaagaactcggcttatgtcctgaaattgaaagagcagtccgttttatgggatttgaggaagcttctccaattcagacaaaagcaattccggctattatcagcggaaaagatattatcggacaggcacagaccggaactggaaaaaccgctgcatttggtattccacttcttcagaagatagacccgaaaaataaaaagcttcaggcaattgtactttgtccgacaagagagcttgcaatacaggttgcagatgaaatccgtaatcttgcgaaatatatgcacggaatcaagattcttccaatttacgggggacaggatattgtgaaacagattcgttctttaaagaacggaactcagcttgttatcggaactccgggtcgtgtgatggatcacatgcgcagaaagactgtaaagatggaccatattcatacagttgtgcttgatgaagcagatgaaatgttaaacatgggatttcgtgatgatattgaaactattttaagtggtgttccagaagaacgtcagactgttttattttctgcaacaatgccaaaaccaattttggaaatcacaaagaaataccagaatcatgcagaactgattaaagtaaccaaaaaagagctgaccgttccgaatatcgaacagttttattatgaagtaaaaccaaaaaataaagaagaagtgttatcccgcttattagatatttattctccaaatctttctgttgtattttgtaatacgaaaaaacaggtagataatctggtaacagctttaatcggaagaggatattttgcagccggattacacggagatttaaaacagtctcagcgtgaccgtgtgatgcagagtttccgtaccggaaaaacagagattcttgttgcaacagacgtcgctgcacgaggaattgatgtcgatgatgtcgaagctgttttcaactatgatttgccacaggatgaagaatattatgtacatcgtatcggtcgtaccggacgtgccggaagaggcggacatgcattttcttttgtcagcggaaaagaaatgtataaattaaaagaaattcagagatactgcaagacaaagatttatgcacagaaagtgccgtctatcaatgatgttgcaaacactaagatggaacatatccttgcaaaggcagattcagtaattgagcgtgaaaatctttctcttatgttagatgccatcgaagaacgtgtcaatgcgtctgattatacgacaatggatatggcagcggccctgcttaaaatgtatatgggaatggtaaaagaagaaaccgaagaggaagaaataacagattttggagataccggtgcagaagaaccgggaatggttcgtctgtttattaatattggtaaaaaacagaaaattcgtccaggtgatattttaggcgcaatcgccggtgaaagcggaatgcctggaaaattaatcggaacaatcgatatgtttgataaatatacctttgttgaagtaccaagagaatatgcctcagaagtcttaaaagcaatgaagagtgcaacaatcaaaggaaatcatattgcaattgaacctgcaaatcgtaaatagcttttttgagtccagtaaaaagtgctggactcatttttttattgcatagaatagtataggtaagtatcaaatggaaaattacattttgttagattttgatttacaagtcataaaagaacatatactgttgtaagattccggcatatcctttatatttttcataaggaaatccatccggataatgttcagctaaaattttttttacgtgtgtatcaatcggaaaagcatctacgtgatgcagagcaaataaggcaatgcaggctgccactttatttccgatgccatattggtctgtcagcattttatgagcagtcgcagtatcctgtttttttaatgtttcaagggaaaaagagccgtctgctacggaacaggccattttataaatatatttgtcacggtatccaagtccaagaccggcaagtccttccattttggcagaggcaagagtttcactttcaggaaaagtgtaataaattttgtcttctggggttatttttttctctccgaatttttcacagagagccactacgctttttcggattctcggaatattattattttgcgaaattagaaatgtaatgatgatttcccataaatcctgatttaaaattcgcatgccccatccataattcacagctttggtaaggtaactatcgtttttgtctacagaggcttttattttgtgataatctgttttcaaatcaaaataagattcccagatttctttaaactcagtttcagaacagtcaaagagtacctgctcatttttttggatgattcgcagatgctttccaaatgcaacattagagaaactgccatctttttctttatggatgcggaaacattgtccggattttgcaatttgttcaatactaaaatcttcgatttgtttttctatcatgattgtttttctttctttaataattttgtgttggttatagaagttataagatcttttaatctttataaatgaaaaaatggattctaccttttccagaacggtcccggtaaaatcctgtaatatccacaagagcagcggaagagatgcagttagaatatctttttttatcaagggaaaacttctcccgaacgggaccgacctcataagaaaagactctaaaattactatatcgaactttactagctttgtcaagaaaattgtcgatatcttccaaaaaaaacgacattatacgataaaattcgtataatttgacaaaaatcgacaagcgaacactttttataaaataagagaagaatcctgcattaggattcttctcattcgacttaagctttataactctcttgtttcaagctgtaatacggcctgacctcttggaataattcttggcccgccagagtgttcaatatattcttttgtaaggataacttctccgatattatcatcttttgggatttcatacatgatatccagcatgtattcttctaagattgcacgaagcgcacgggctccagtatgtttttccaatgccatttttgcaatcgcatgaagtgctccttcttcaaattcaagttttacttcatccagtgccagtaatttctgatattgttttaaaattgcattttttggttcttttaaaatctgaacaagcatttcttcagatagaccgtccagtgtaaagataatcggaagacgtcctaaaaattccggaatcataccaaatttctttaagtcatcaacagttactttatttaaaagcttgctgtcattgtcatatttatcttttaagtctgccatgaatccaatagaagcctgtttatttaaacgttctttgataatggattcaaggtcgggaaatgctccgccacagataaataaaatatttttggtatctacagttgcaagtggaaccattgcatttttgctgttggcacctaccggaacttcaacctcgctgccttctaaaagttttaacattccctgctgtacagcttccccgctgacatctctttgattggtatttttctttttggcgattttatcaatttcatcgataaaaataattccgtgttctgccttttccacgtcattatcagcggctgcaagcagtttgcttacaacgctttcgatgtcatccccgatatagccggcttcggtaagagaagtagcatctgtgattgcaagcggtacatcaagcagtcttgccagtgtcttgaccagataggtttttccacttccggttggtccaatcataagcatattggatttttcgatttcaatttcatcggcattgtctgcaaatactcgtttataatgattgtaaacggccacagacattactttttttgcatattcctgtccaattacataagaatccaggctttctttgattttatgaggtgccggtatactgcggatatcaaatacctttttggcgattttttcatttgcttctttttcaggctgagcttttttctttttaattctctgtttttttggaatttcattttgtaatgaatttaaatcaaccatgctgatgttgggcatgtttttcattaattcactgtaatccatcggcatattgttcatagaattaaaactcttctgcatacagtccatgcagacgtgaattccgcccggaatatcgatcatttttccggctttgctttccggacgtctgcagataaagcagacattttcataatcttctttgttttcttcttcctgttctaaataatccttatcttctgccatagtttcccctgctttccatctatctatatgatttttgttctctgtataagcttatatgtctgtgggtatcttaacataattcataaattcgaacaagtaaacttttcatgaaaaaagtctaaaatgaaaaaacccaaagataggtcttgtatgtaaggtggtagatttggtaaaataaaaacaataagttaaaaaagcaaagaacaggaaaaaaagatgatactaagaattaaaagtatgtggaagatgataaaatataatatgataagtctgcttttgtttgaagcaggatatcgggttgctacttttttaattattacaaatttgacttcaacagcagttaattactctttaaaaaagcgcaatttcagttatctgacagcagaaaatttccacaaatttttacaaaatccaacttccctgatttttctttttggaattttattgctgattttatttttctttttaatagaaatttcagcggttttatcatgtttttcccattcctatcaaaaacgaaaaatctataccagtgatatgttgattgaaggaatccgacggacgttgcattttttaaaacacagtcagagctcctggattatatgtattttgatggcagctccgtttttgtcggtctattttttaattatggaaatctcttattttggagtgcttcagtacagtgtgatgcagatctataaatgggtgaagccacactggattttatatctggcggttggagttattttggtgatttcttttctggcggtattttcgcttccctattgtttgctggaggaaagaaaaagcagcagaggattaaaatcaggatggattcttttaaaatggcactggaagcgaattattttaggttttgtggcactccatatcgtgatgcttgcagttatcatgggtgtttattttctggcaaatgccacagcttccggttatgcaattttaagcaaaccaaagtcagcagttgtaagcgcagtgcttgtctataatgactggattcgtatggaaatcggtatctttgcaggagcactccagctgatgctgagccttgcctttgtttattttatttatgcgcgttaccatatccagaaaaaaagtgaagcgggaattgctgctattttcagacagaaattatggtatcagaaaatcggtcaaagaagagcagcggccatctttactgcgattttactcgtcatggaaggttcttatctggttgtactggcttctgaccatagcagtgccgtaaacagtctgatgagtacaaccggagtcactgcacacaggggaggggctcttatggcaccggaaaatacaattagttctctggattatactataaaatgtggagcagattacgcagagattgacgtgcaggaaacagccgatggggaattggttctcctgcatgataattctctaaaacgaacggcgggtgtaaagaagaatgtatgggaaatgacttatgcagagattgcacagcttgatgcaggttcaagttttaataaaaaatttcgtggggaaaagattccaacattagatgaagtattgaaattctgcaggggaaaactggatttgaatattgaaattaaatacaatgggcaaaataaaggaattgtaaagaaagttgtgcgtataatagaacagaaccatttcgaggatcattgtgtggttacttcgatgaattattcgtttttgaagcaagtgaaaaaggcaaatcctgacatccgtaccggatatatcatgacgatgacttatggaaccatttcacggatagaagcagcagactttttcagtgtgaaatatacttatgtggatgaggcgtttgtgagggaagcacattctcttggtaaagaagtacatgcctggacggtgaattatcgtggagatattaagcggatgctggatgtgggcgtggataatattatcacggataatccggttttagtgagaaaagttaaaaaccaggaaagtgatatgcagactgacttttgggatttaatgcgctatgcatttaagatgtgagaaaaaactgttgacaaatagtggcaaagaagatatactttgagcatcaaagtaattttgagcctaattgaaaaaaataaaaaatgagatatattttataaggagattaaagattatgttagaaaaaatgagagaaattattgcagaacagttgaattgtgacgaaggagaaatcaacgtagatacttcttttaaagatgacttaggagcggattccttagatttatttgaattagttatggctttagaagatgaatattctgtagaaattccggcagaagaacttcaggaattaacaacagttggtgctgttattgactatttaaaaaataaaggcgtagaagaataagaaagactggaatctgccgcaatggtaagaaataactcttgcggcagattctttttaggtaaatagtttgaaatacaaaatattctagtttcaaaggagttttatatgagcaagacagcttttatttttccgggacagggagcacaatataccggcatgggaaaagatttttacgaagaaattcctgtgtgcagggaaatgattgatttagcaggagaagttactggtcttaatatgccggcactgttatttgaagaaaacgaagagttaaatattacagaatatacacagattgcaatgcttagtgtggaagttgccattttaaaggcattggaagcacagggagtgaaagcagatgtgactgccggcttaagtctgggtgaatacgctgcctgtgtctgtgcaggaactcttttagaaaaagatgcttttttactggtcagaaaaagaggaattttaatgcaggaggcagttccgagtggcggtgcaatggcggcagtaatgggaacaggtgccgatttgattgaagaaatctgtgaaaagacggaaggaattgtatcgattgccaattataactgcccggggcagattgtcattaccggagaaaaagaggctgtagaaagagcatccgaggcattaaaagaagctggagcaagaaggattgttcctttaaaggtatctggtccatttcattctgcaatgcttgagcaggctggagaagcacttggagaagtattggatgcaatagaggtaaagaaaccggaaattccttatgtgacaaatgtgacagcacaatatgtgaccaaggcagaagaagtcaaaccactgcttgttaaacaggtttcctcttctgtaaaatggcagcagtgtgtagaagcgatgattgaagatggggtagatacctttgtggaaatcggacctggaaaaaccttaagtggatttatgagaaaaattaaccggaatgtgaccgttatgaatattcagaataaagaagagtttgaaacggtagtaaattgtttgaaatgatttaaccaaatcaagcaagtagcgaaagcggattgcgaatatccgcttgacaataaacggatttgaaatttgaaattaagaaaggcagaatcatgttagaaggaaaaatcgcattagtaaccggcgcaggaagaggaatcggaagagcagttgccttaaaacttgcagggcagggtgcagtggtagtggtaaattataacggctcgaaagaaagagccgaagaagtcgtaaaaaccattttggaaaatggaggaactgcatctgcatatcagtgcagtgtcagtgattttgaagcctgcgaaaaaatgataaaagatgtgattgcacagtatggacatcttgatattttggtaaataatgccggaattacaagagatggactgattatgaaaatgaaagaagaagattttgatgctgtcattgagacaaatttaaaaggaacatttaatacaattcgtcacacaacgagatggatgttaaaacaaaaaggcggaaaaatcatcaatatttcttcagtgtccggaatccttggaaatgcgggacaggcaaattatgcagcaagcaaggctggtgtgattggtctgacgaaaacaatggcaagagaacttgcaagccgtggaattaccgtcaatgcggttgcaccgggatttgtggaaacggatatgacagaggtgttaccggaggctgtgaaagaaacttcctgtaaacagattccgcttggaagatttggaaaaccagaagaaattgcaaatgcagttgcatttttagcatcagaagaagcagattatatcacaggtcaggtcatcagtgtcgatggcggaatgagcatgtaggaggacgttatgagacgagtagtaataacaggaatgggagcaatcactccgcttggattaaatgtagaagagttctggaacggattaaaagaaggcagacatggatttggagaaattacccgttttgatgcctctgaatataaagcacatcttgccggtgaagtaaaaggatttgtcggaaaagaatttatggatgcaaaggcagcaaagagaatggaactgttctgccagtatgcggtcgcagccacaaaagaagccatcgaagaggcaggtcttgacatggagaaagaagatgcttaccgtgtgggctgttcggttggttcaggaatcggaagccttcaggcaatggagcgtgaacacaccagattattagaaaaaggaccaaacagaatcaatcctttattagtaccaatgatgatttccaacatggcagcgggaaatgtatcgattcaatttggattaaaaggaaagagcttaaatgtcgtaactgcctgtgcaacaggaacaaactgtatcggtgaagcttatcgcagtattcagtttggtgatgcagatgtcatggtagcaggtggaacagaagccgcaatcagtccgattggaattggcggatttgctgcattgactgcactttcaaaatccacaaatccagaccgttgttcgattccgtttgataaagagcgggatggatttgtaatgggagagggcgctggaattgtcgtattggaagaattggaacatgcgaaaaaacgtggtgcaaagattttagcagaagtcgtgggatatggagcaaccagcgatgcctatcatatcacttctccggcagaagatggagaaggtgctgcaaatgcaatggcaaatgccatcaaggaagcaaaaattcagccagaagaggttacttatatcaacgcacatggaacaagtacccatcacaatgacttatttgagacaagagcaattaaaaaattgtttggggaacatgcctataagatgaaaatcaattctacaaaatccatgattggacatcttttaggagcagcgggagcagtggaagtgattgcctgtgtaaaacagatggaaaacaattatgtacatacaacagcaggatatcaggtaaaagatgaagaatgtgacttggattatgtagcgggaagcggagtaggaatggaaattccgtatgcactgacaaattctctggggtttggtggacataatgccagtctgttgcttaagaaatggaatgactaggaggtagcttaaaatggaatttgaaaaaatgattgaattaatcaagaccgtcagtgattctaatctgacacagttccagatagaagaagacggctttaagctttccatgaaaacagataaacagtccaaagtagtagttcagaagcaggaaagcgtaccaaaagaaattcaaagtgttgcgatggatgagattaaaccggcagaacaaaaagaaatcaaaaaagcagagggaaatgttgtgaaatctccattagttggaacattttacagtgcctcttcaccggattctgccccatttgtaaaagtaggagataccgtaaaaaaaggtcaggtacttggtattgtagaagcgatgaaacttatgaatgaaatcgagtccgaatttgacggagtcgtaaaagaaattcagattgaaaatgaacaggttgtagaatatggacagccattatttgtcattggttaggagaaatcagatgaagcttacaacaaaagaaattatggagattattcctcatagacagccatttttattaattgacacgattgaagaattagagccgggtgtacgtgcagtcggaagaaaatgtgtcagctacaacgagccatattttgcaggacattttccacaggagccagtgatgccaggtgttttacagattgaggcacttgcgcaggtcggcgctgttgcaattttaagcaagccggaaaataaaggaaaaactgcttattttggtgcaattaacaatgcgaaatttaagacaaaagtcgttccgggtgatgtgttaacgttagagcttgaaattataaaagaaaaaggaccgattggagtaggaaaagcggttgccaaaaatcaggagggcaagattacagtctcagcagaactgacatttgcaatcggataggagtgtggaaaaatgtttcataaaatattaattgcaaatcgcggagaaattgcggtccgtattatcagagcgtgtcgtgaaatgggaattaagacggttgcggtttattcggaagcagataaagatgcgcttcatgcccagcttgcagatgaagcagtctgtattggaccggctccggcttcagaaagttatttaaatatggaacgaattttaagtgcgacggtggcaacaaaggcagaagcgattcatccgggatttggctttctctctgagaacagtaaatttgtccgaatgtgtgaaaaatgcaatgtggtatttatcggaccgtctgcagatgtaattgacaaaatgggaaataaatcgcaggcgagaaagaccatgcaggaagccggagtaccagtcgttccaggcacaaaagagccggtttatactgcaaaagaagctttagaagaagcaaaaaaaatcggatttccgattatgattaaagcatcctccggtggtggaggaaaaggaatgagagtttctgaaagtgaggcagattttgaagaaaattttaataccgcacaaagagaatctattaattcctttgcagatgatacgatgtatctggaacgctatgtgggacgtcctcgtcatgtagaagtacagattttaggagataaattcggaacagccgttcagcttggagaacgtgactgttcgattcagagacgtcatcagaagatgatagaagaatctccatgttgtgcaattactaaagaaatcagaaaaaaaatgggtgaaactgcagttcgtgcggcaaaggcagtcggatatgaaagtgccggaacgattgaattcttactttcagaaaccggagaatttttctttatggaaatgaatacccgaattcaggtagaacatccggtgacggaatttgtctcaggtgtggatttgattaaagaacagattcgtatttcggcaggacttccgatttctgttaagcaggaggaaattcaggttaagggtcatgcaattgaatgtcgaatcaatgcagaaaatccgaagaaaaatttcatgccgtgtccgggaaagattgaaaatctgtatcttccgggaggaaacggagtaagaattgataccgcagtttacagtggttatcagattccgcccaattatgattcaatgattatgaaagtgatcgtatatgacaaagacagggagtctgcaatcgcaaagatgcgaagtacgcttggggaagtcgtcattgaaggggttcagacaaatctggattttcagtatgatattttaaatcagaaagattttttagaaggaaacgtaaccacacattttattgaagaacattatgagtagtaaggagcaggcgaaatgtccagattgaaggatttatttaaaaaatcgacaaatgaatcagccaaaacagaagaaataaatgaagcccagtttggtccgtctgtaccagaaggtctgtgggtaaaatgtccaaaatgcggagaactgctttataaagaagatgtagtaaaaaacagttatgtctgcccaaaatgtcagggatattttagaatgaaggcaaagacgagaatccgcatgattgcagataagggaagttttaaagagtggagtacggatattaagacaaagaactttttgaattatccgaattatgaagagaaaattgccgaagtgcaggaaaagactcacttagaagaagcaatcaaaatcggagaagcccagattgataagacaagagtcgtgcttggagtctgtgatgcccgttttttaatgggaagcatgggatatgtggtaggagagaaaattaccagagcatttgaatgtgcgacaaaagaaaagcttccggttattttattctgctgttcgggcggagcaaggatgcaggagggaatggtttctttaatgcagatggcgaaaacctctgcggcaattaaagcacacagcaaagcaggactgctctacattccggttctgacagacccgacaacaggaggagtgaccgcaagttttgcaatgcttggagatattattctggcagagcctggagcactgattggatttgccggtccaagggtgattgcacagacaattggacaaaaacttccggaaggattccagcgttcggaatttttagtagaacatggaattattgatggaattgtaaaacgaaatgatttacgaagaaccttgtccggtcttgtaaaactgcatgagcgaaatgcaagttatagtcagtttaataaaatttgttttcagggtgaacagaaacagaaaatcgaaacaaagaagcgaagaaccagaaaaaaagaaatgactgcatgggagcgggtagaaatagctcgtgattctaaaagaccaaccagtttggattatattggaaagatatttgatacctttatggaactgcatggagaccgtgcctttcgagatgatggggcaatgattggtggacttgcattattggacggacaaccggttacggttattggagtacaaaagggtcgtaatacaaaagataatattacgagaaattttgggatgccgtctccggaagggtatcgaaaagcacttcgactgatgaaacaggcagaaaaatttaatcgtccgattatcaattttattgatactcccggagcattttgtggaattgaagcagaagaacgcggacagggagaagcgattgccagaaacttaatggaaatgtcggatttaaaagttccggttttaagtattgtaatcggagaaggcggaagtggtggtgcacttgccattggtgttggaaatgaagtctggatgctggaaaatgccacttattcgattttatcgccggaaggatttgcctctatcttatggaaagacagcaaaaaagcaaaagaagctgcggaaattatgaaaattacggcaaaggatttaaaagcacttggaattattgaacaggtgattgaagaaccatatccggcatgtgaagaaaacttagaagaaatttctgagaatatgaaaacgaagatgcgagaatttcttcagagaatggataaaaaaacaaaagaagaactggcagaagaccgttatgaacgtttccgcaagatgtaagaacttaggaagataagaagaaataggcaggaaaaaatatgagcaaatcattaaaaataggagatttggaagtgaaaattccggttgtgcagggcggaatgggcgttggaatcagtctttcaggacttgcaggaaatgtctctgcctgtggcgggcttggtgtgatttcaaccgctcagataggctggagagaaccggatttttatgaaaaaccatttgaggcaaatttccgtgcaattgaaaaagaaattaaaaaggcaagagaactggcaaaaggcggagtgcttggagtgaatatcatggtggcaacacagcgttatgaagagtatgtaaaatcagccgtaaaagccggaattgacattgttatttccggagccggactgccgattgaccttcccaaatatgtagagggaagcaaaacaaagattgcaccgattgtctcttctttgaaatctttgacggttatctgcaggatgtgggagcgaaaatatcagacagcaccggatttggttgtgattgaaggaccaaaagcaggtggacatcttggattttcaagagaagaattagaaactgttacagatgaggcttacgatgacgtgattgtctcgattattgaaaaagtaaaagagtatagtgaaaaattctcaaaaaagattccagtagtagttgccggcggaatttatgagcgaaaagatatggaacacgttatgaaacttggcgcagatggagttcagatgggaacaagatttgtgacaacgaaagaatgtgatgccgacgaagcctacaagcaaagctacatcaaggcaaaaaaagaagatataaagattgtacaaagtccggttgggatgccgggacgtgcgattctaaatccatttctggaaaaagtaaaaacagaaaaatgcaaaatcaaacactgctatcagtgtattgtgacctgcgataaaaagacgattccatactgcattacagaagcgctggttaatgcagcagagggcagagtagatgaaggtctgctgttttgcggagaaaatgcatatcgtgcagataagatagaaacagtagcagagattatggaagagtttcgataaaccgataacaaaaagagtcctgaaatcaggattcttttttgtttatcaggtatttcaagaatagttaacacttgaaaagtcaaaattcataaggtataattttagtcgtatcgatggagtcgagaaaaaagtctgaaaaagacgatttttaaggagatagaaaatgagtacagtaagaacaagattcgcaccaagcccgacaggaagaatgcatgtcggaaatttaagaactgcattatatgcttatttaattgcaaaacatgaaaacggaagttttatgcttcgtattgaagataccgaccaggaacgtttcgtagacggagcactggatattatttaccgtacactggcaaaaacaggtctggttcatgatgaaggtccggataaagatggcggatatggtccttatgttcagagtgaaagaaatgcacagggaatttatttaaaatatgcaaaacagttaattgagcagggagatgcttattactgtttctgtaccaaagaacgtctggaatctttaaaatccaacgttggagaagatggaaaagaaatctctgtttatgataaacactgcctgcatttaagcaaagaagaagttgaagcaaaactggcagcaggagaaccgcatgttattcgttttaacatgccgacagaaggtacaacaaccttccatgatgatatttatggagatatcaccgtacagaatgatgaattagatgatttaattctgattaaatccgatggatatccgacttacaactttgcaaacgtaatcgatgaccatctgatgaacatcacacatgtagtaagaggaaatgaatatctttcttcttcaccgaaatacaatcgtatttatgaagcatttggatgggaaatcccgacttatgtacactgtccgttaatcacaaacgaagaacataaaaaattaagcaaacgttccggacattcttcttatgaagatttattagagcagggattcttaacagaagcaatcgtaaactacgttgcactgcttggatggtgtccacaggacaatcgtgagattttcagccttgaagaactggtaaaagaatttgattaccatcacatgagcaaatctccggctgtgtttgacatgacaaaattaaaatggatgaatggcgaatacattaaagcaatggattttgataaattctatgaaatggcacttccatacattcagagtgtaattaaaaaagacttagatttaaagaaaattgcacagatggtaaaaaccagaatcgaagtattcccggacattccggatttaattgacttctttgaagcagttccagaatacgatgttgcaatgtatactcataagaaaatgaaaacaaatccggaaatttctttagaagtattaaataaaatcattccggtattagaagcacacgaagattacacaaacgatgcattatacgaattactgtgtggatttgcaaaagaaaacggatacaaaaacggacagattttatggccgattcgtaccgcactttcaggaaaacagatgacacctgccggtgcaacagaaatccttgaagtacttggaaaagacgaatccattatacgtttaaaagcagcagtagaaaaactttcttaattcaacaaatatagcaaggattctcccacctctataggtggtgagagaaattgcaaacagaaaggttaacggcagtgatgggcggagagaaatcggtatcccccactgacatgaggtaaaccacagtcagcgttttgctgacatgtcagactctgtgaaattaccgactgtgggttgaaacaatttgaactggagaaaagtaaatgaaagaaaattcagcacaaaaccgtgcgatttcccatgataaaggaccgatgatgcttcttgccggtcctggttcagggaaaacaacgacgattacaaagcgagtggtgaatttaatacaagaaaaaaaagtgactccttcttctattctggtggtgacctttacaaaggctgctgccagagagatgaaggagcgttttttacgcctgtgtaaagaaaaaaatgtgaatgcgccttatgaacaggttacctttggtacgttccatggtgtttattacactattttaaaatatgcttatcacttaaatgcgcagaatattttaagtgaagagcgtaaatatgatatcttaaaagaaattgtatatcgccagaagcttacgatagaagatgaaaaagaattttttcagggactggtacaggaaatttccatggtaaaaaacggacggattccactcgaacattattattcagccaattgtccggatgatacattccgtgcgatttatcaggcttatgtgaagcgatgcaaagcttcaaaactgcttgattttgatgatattttattatatacttatgaacttttgacaaaccgaaatgatattttaagaggctggcagaagcgtttttcctatattttagtagatgaatttcaggatattaatcaactgcagtatgatgtggtaaaactgcttgcaaagccggaagataatttatttatcgtaggagatgatgatcagtcaatttatgcatttcgaggtgcaaagccggagattatgctgcattttccagaggattatccggatgcaaagacagaactcttagcttgcaattaccgttccgcttctaccattgtagaactttcccagaaagtgatttcagaaaactcaagacgttataagaaagaattatttgcagatagaatgggtggaaatcctgtaacaatacaggcgtttgaagatggaaaacaggaagaattatatgtaaaaaatcaggtgcagaagctgttaaaagaagggattccttatgaagagatggcagttttgtaccgcaccaattccggagcacgttttcttgtggaaaccctgatgcggtaccagattccattttgtatgcgggatacgcttccaaatctttatgaacactggattgcgcaggatgtgatttcttatatccatattgcaatgggtgagagaagccgaagagagtttttacggattatgaatcgtcccaaccgctatttttcaagggacgctttggatgaggcacaggtttcttttgagggactgcgttggttctatgaggaaaaagactggatgtgtgaccggattgataaactcgaagaagatttgaatacattaaaacgtatgacaccctatggcgcgattaattatatccgttatggaatcggctatgaagaatacttaaaagagtacgcagggtatcggaaaattaagtcagaagaattgtttgaagtgatggaagaactggcttcaagtgcaaaaaactttaagtcattttcggaatggtttgtccatatagaagagtatacacagcagttaaaagaacaggcaaaaaaacaggtttcagagaaaaaaggaattacgatatctactctgcacagtatcaaaggacttgagtttgatgcagtctttttaatggatgttaacgagggttcccttccctatcataaggcagtgacagagagcagtatagaagaagaacgacgtctgttttatgtgggaattacaagggcacggaaatttttatggattttatatgcaaagaatcggcatgacaaagaattggaagtctccagatttttaacggaaagcggtctggtattaaaagaagagaaggataagaaaaaatgacaaatcagatatggatttactatggaaaaatagaaaatctggtaaaagaagaaagttcaaaacaaaagcgggaacgaacagccggaagactactgttgttaaatgcaataaagaaaagcaacatccaaaccattcaaaatctggaagaactagaacagtctattgaaatcggagcacatggaaaaccgtattttaaagacaaaacccgctttcctttttttaatatcagccattccggagactatgcagtctgtgcagtggcaacttgtgaaatcggaattgatatccaaaaaatacaatcttacagtccaaggcttttaagacggatcttaacgaaacaggagctgttacagcttgaacagtcagaggaaaaagaatctttcttttgcagtctctggagccaaaaggaaagctatgtaaagtggagtggtcagggaattacgagagaacttgacactttagaaaaaaatgcatggcaggaaagtttttcaatcgaggattactgggtctgtgtaacagcacagtctgcgtgtgaaattgagtgcataaaagaatcagaataaaaaaagataaaggaaaacggcaagaaagaaattcctgtattaaataaagattgtcctcatatattattttaagaggtgaacaagatgaaagaaaagggaattacatatctctttcctgctaaaatacgggaaatactcgaaaagaccggatttaatttggaagagctttatgaaatcaggcttcgggttaatgctccgatgattgtaatctacggtgggaaagaatactttgttgcgaaagatggaaggctgaccaaaaatatgcagaatgtctgcatgattgaggcagaagatttgcgggaaacaatggaatatgtcagtaattattccatgtatgcattcgaagaggaaatccgaaagggatttattacaattcaaggcgggcatcgggtcggaatagccggaaaaaccgtcttagatggggataaaataaaaagtctaaaatacatatcttatatcaatctgagattatcacatcagataaaggggtgtgcgaccccaattctcccttatattatgaaaaaaaataatgtgtgtcataccttgattatttctccgccgatgtgtggaaaaacaacactgcttcgggatttaatccgccaggtcagtgatgggaatcgttatcttgaggggaaaacggtgggagtggtggatgaacgttctgagattgcaggctcttatcagggaattccgcaaaatgatttgggaatccgtacggatattttggactgttgtccaaaagcggagggcatgatgatgctgattcgttcgatgtctccggaagtggttgcagtggatgagcttggcgattatgaagacattcatgcgattgagtcagtcattcactgtggctgtaagctatttgcaaccgttcatggtagttccattgatgatatgaagcgaaaaccgttgatgcagagactcatgcaggaaaaagtgtttgaacgttatattattttgcaaaataaggacagggcaggacaggtcaaggcaatttttgatgaaagaggaacgtgtctgtatgaccaaaaccgaaaaaagggaattttatgttaagagtggcaggtgcatgtctgatattaagtgcgtcctctttgctgggtgtacaaaaaagcaggcagtttacaaaaagaatcgaacagcttcaggaattacaacggattgtgctgttgattcaaggagagattctttataagaacgcagcacttccggaagccttaagaagcagtgccggaaaagtaaaagtaccgtttgattcttttttaagacagacagcaggaagggcagatgcctttgatggagtccgtttttctgatttgtttgagacagaaataaaagagcagttaaaaggtacagcacttacaaaagaagataaagaggaatttgcccgttttggagaatcgcttggatatctggatgtggaaatgcagaaaaatgcaatgaagctttatttaaaagaactcgaacaaaaaattgaatatctgcaaaaagaaattccacaaaaaagaaaattgtatcaaagtctgggggtcatggggggaatctttcttttgattttgctctggcagtaaaaaagcgaaaaaaagctgaaattgcaggggagggaagtacttggaagttacgattttatttaaaattggagcagtcggaattcttgtttcggtactttgtcagattttaaaacacagccagagagaagaacttgcttttctcaccagtcttgcagggcttttagtcgtactgttctgggtgcttccttatatttacgaactctttcagacgattgaagatttgttttctttgtagggggcaggatggaagttgttaaaattgtgatgattggaattacgggagttcttttggcactctttttaaaagaaagtaagccggagtattctgtttatctgagctttgccgttggaatctgtattttaggatatgcagtggaaaaattatcctatctgtttgagagtatcaaaaaaatacaggaatttcttccggtagatgaaaagtatgtgcttgttctgcttaaaatgacaggagcaacctatattggacagttttcatcaagtatctgcaaagatgccggatatgcagcaattgcaggacagattgagttatttgtgaaactttatcttatggtattatctttaccggtgttactggcactggttgagaccattcataattttttattatgaaaagaagaattcgattcatactggcagtctttttgatctgtctggaatttggagcaacttttgtacaggcagggcaaaaacagagagaacagcaggaagaagaaacaagacagaagctgatggaagatatggaacttgggcaaatgcaggatgcagtcaatcagattttaaaagaggacagcttttccatagaagaaatcttaaatcagattttaaaaggagagtctttgtttcaaaaagagacaatgagtaagtggtttaaaaatatagtaaaagcacagcttcaaagagaacaaaaggcaatgtttcaagttgtacttttggtacttcttgcagctgtgttttctaattttacagcagtatttggagatggaaaaaccggagaaaccagcttttatattacttacatgcttttgcttgcattattgataaaatcgtttggaagtatgggagtggagttaaaagaacttctggaaaattttattttatttttaaaagctttaatgccgtcttattttcttgcggttacggcttcctcaggaagtgcgacggcaatgattttttatgaagcagtgctgtttttaatttatgtgattcaggttgtctttttaaaaggcattgttccggccatttatgttttggcacttgtagaactggtcaattatcttcacagcgaagatttcttatccaaaatggcagagctgttgcagactttgattgaatggagtttaaaaagctgtatggcggtggtgcttggcatgcagttgattcaaaatatgattggaccggcaatggattctctaaagcgggacatcattggaaagacagcggcttcgattcccggaatcggaaatgccattaatggagtgacagaagttgcccttgggacagccgtgattatccgaaatggaatcggtgtagtgggaattattattttagtctgtatcggaatccggccggtgattcgtctggcgctgcttgcatttttatataaactgttggcagcggtagtacagccggtatcggacaagcggatgacaggagcacttagcacaattggtaatggctatgttttatttttaaaggtactgctttgtatggaacttttgatttttatcacgattgcaattctaagtatttcatttatcggaaaataggataaaaatcaggcaagtcaatatgggaggggagtcgatgccggagagagtttgtctatggatgcagagtgttgcctgttattttatctttcagtctgcacttctgcattttctgccagagggaagttataaaaaatacattcagttttacatgggacttttatttatctgggttttgattgtaacaggagggaagcttttaggagcagaggaaaccatgtttgagatgccggatatggagcttcaagaagagacagagagtcaaaaggaatgggagcagaaggcttatgatgcagaaaaccgctattggcaggaacgggaagaagaggtggacaagccatgagaggatttccggacaaattaaaaaaagaatatctggcggttgctctgttagttggaattttgtgtctgatacttgcaattccggtgaaaaaagagacgataaatgagacaaatacagcgatagaagagaaaagtgaagatttaaaagaaggggcatggcaggagcagattcaggcaaggcttcaaaacatgctcaatgaatcggagggggcaggagagacgaaagtatttttaacctttgaaaacagttgggaaaatgtagtagaaaaggatgaaaaccagacggtgtttcaaaaagatgcaacaggaaatcagactccttatgtaaaaatgcagaagtatccgaaaatcagcggagttttgattcttgcaaagggagcagataatccggtagtggtacagaatattcaggaggcagtgcaggcattatttcaggtggaagcccatagaataaaagtaatgaaaatgaattaaaggagaagcgtgggtgaaaaagatttttaagaaaaatcaggtgattattactgctttggcaattatgattgcggttgccggctacattaattactcagacacacatctgggaatggataaggtactacagaaaacaggtgctgtttcggatacctcagatacggaggcgcaggaaaccgcaggaacagatggaattgtagaagagattgacagtctggattatgatttgacagatgaaagtgccctgttagaagaaaatcaggcagcagggaacaatcaggcaggagaagcgagtgcatctgccgagacacctggagaagcagtattaacaggcgcatccacttttgctgcacaggcaaaactgaatcgggagcaggtacgttctgccaataaagaaacactgatgggaattatcaacaacgaaaatataggagaggataaaaaacaggaggcaattgcttcaatggtagaaatgacagaccttgcagaacaggaagaagccgcagaacttttactggaagcaaagggatttgcaaatgtagtggtgaatctgaccaatgaatcggctgacattattgtaccgcaggagtatatggcagatgacaagcgggctcagattgaagatattgtaaaacggaaaacatcggttccgatagagaatattgtgattactccgcttgaagcggaaagctcggatggcgaataaatctttttaaaatccttgacactgtttgtacggtatactaaaatatgctaagtgtttacttatgaaaattttaatttgagataaaaaaagagaaggaggtcatttcagtggctgactatacaaaagaaattacaaaaagaagaacttttgcaattatttcccatccggatgcaggtaagacaactctgactgagaaatttcttctttacggaggagcaatcaaccttgcaggaagtgtaaaaggaaaggcaacagctcgtcatgcggtttcagactggatggaaattgaaaaagaaagaggtatttccgttacatcttccgtacttcagtttaattatgacggttattgcattaacatattggatactcctggacatcaggatttctcggaggacacatatcgtactttaatggcagcagattctgcagttatggtcattgatgcttcaaaaggagtggaggctcagaccagaaaactgtttaaagtttgtgcgatgcgccatattccaatttttacgtttattaacaaaatggacagagatgcaaatgatacctttgatttactggatgatatcgaaaaagagcttggaattccaacctgtccgattaactggccaattggttccggtaaaaaattccgtggtgtttatgatagaaatacagaaaaagtgctgacattctcagataccatgaagggaacaaaagagggaatcgaagaagaaatcggaattgatgaagcacacttggatgatgtagtggatgcagaacagaaagagcagttattagaagaaattgaactgctcgatggcgcaagtgcggaatttgaccaggacttagtcaacgaaggaaagctttcaccggtatttttcggttctgcgcttacaaactttggtgtggagacatttttgaaacatttcttaaaaatgacttcttccccgcttccaagaaaggcagatatcggagagattgacccgatgaaagaagatttctctgcctttgtatttaaaattcaggcaaatatgaataagaaccaccgtgaccgagttgcatttatgagaatctgttccggtaaatttgaggcatccaaagaggtgtatcacgtacagggcgagaaaaaaatgcgtctctcccagccacagcagatgatggcgcaggaccgtcatgtggtggaagaagcgtatgccggagatattatcggtgtatttgacccaggtatcttttcaatcggtgatacggtatgtgcaccgggaaaaaaattccagtatgaaggaatcccaacgttcgcaccggaacactttgcaagagtacgtctgcttgacagcatgaagagaaagcagtttgtaaaagggatcaaccagatcgcacaggaaggtgcgattcagattttccaggaaatcatgggcggaatggaagaaattattgtcggagttgtcggtgtgcttcagtttgatgtcttaaaataccgtctggaaaatgaatacaatgtggatatccgtcttgagacactgccttatgaacacattcgctggattgaaaataaagatgaagtagacgttaagaaactgaccggaacttctgacatgaagaaggttatggatatgaaaggcaatcctctgttattgtttgtaaacagctggagtgttggcatgaccttagatagaaatgaaggattaagactggctgagttcagcagaaactaagaaggactccgttttctgtttaaaagacaggaggcggagattcttttttatattttctatagaagttttgacaccacaattatattttgatataatgtcaggtaggagattatccttttaaaaaataggaggtttggttatggcggaagatagaaatatctataagatacatgataatggctcattgggcgaggttcagattgccgatgaagtggttgctattattgcgggactggcagcaacagaagtagaaggtgtcggttctatggcaggaaatatcacaaatgaactggttggaaaactgggaatgaaaaacctttcaaaaggggtaaaggtagatattttagaaaacattgtctgcgtggatttggctttaaatatcgagtatggatacaatattttagagacaagtaaaaccgtacaggaaaaagtaaaagcagcaatcgaaaatatgacaggtcttgtagtctctgatgtaaacgtgcgtattgcaagtgtagagatggaaaaagaaaagacaaaatagttctttgaaaaatgaaacacagatagagtaaaaatgaaaaggtgtctcgcaaaaggacacctttttttataaatggaggataagatgaaaagaagagaaatgagagaacatatatttaagttattgtttatgggagaattcaatacagtagaagaaatgccggaacagagcagtctgtattttgaaacattagaagaactttctccacaggaagaagaatatatgcgtggaaaatatgaaaaagtattagaacacgtagaagaaattgatgagttattaaacaaggtatcttccggatggaaagtaaaccgtatgagcaaagtagacttaaatatcttaagacttgctgtttatgaaatgaaatacgatgaagatgtaccgtttaaagttgcaatcaatgaggcagttgaattaagtaaaaaattcggaggagacgaatcttcttctttcgtaaatggtattttaggaaagattgccaaggagcagtaaaaggaatatgaatcggacctattcggttggacagattaaccgttatattcaaaatatgtttacgcaggattttctgttgaataaaatctctgtaaagggagaagtttcaaattgcaaatatcatacttcggggcacatttatttttcgctgaaagatgctgcgggaacgatatcctgtgtcatgtttgccggtgcgagaaagggtcttgctttttccatgaaaaatggagacaacgtggtagtcaaaggcaaagtggaagtatatgagcgggatggaacgtatcagctttatgccagagaaattaagttagaaggtgccggagcattatatgaaaaatatctggcgttaaaagaagaattagaagacatgggaatgtttgcaccggaatataaacagccgattccaaaatacattcagaaacttggaatcgtaactgctgcaaccggtgcagcggtgcgtgatattcaaaatgttgcgggaaggcgaaatccgtatgttcagctgattctttatccggcacaggtacagggaatcggagcaaaagaaagtattgtaaaaggaattgaaatgctcgatgcttatggcgtagatacgattattgtcggtcgtggtggtggaagcattgaagaattatgggcgtttaatgaagaagaggttgcaagggcaatttttgaatgtcgaacaccgattatttctgcggttgggcatgaaacagatacgacgattgcagattatgcggccgatttgcgtgcaccgactccgtctgcggcggctgagcttgctgtatttgagatacaggatttattgggaagattggaagagtatcatgcaaaattaaaccgtgaactgcaacagcagattgctcaaaagcgacaaggcttaaaactgtatgaaaataaattaagttacttgaatccaaaaagtcagatagaagagaaaaaacagcattatgaaagtattcagatacggctggaatctgcaatgaaaaccaggattttaacttccagacaggaattgaggctttatattgagcggatgaaaggtctgtctccgttggataaattaaatcagggattttcttatgtagaaaatgaagcgcataaggcggtgacgagtatttcacaggtaaaatcaggtgagacgcttctgattcaggtaagtgatggaacaatagaagccaggagtatcggaataaaacaagtagaaagaggtgtgtttgatgacaccggatttgaaacaaaaagaaacacagacgattgaagaagcttttgaagaactggatggaattgtggagcagttggaacgtgcagatgtttcgcttgaggagtcatttttgatttatcagactggcatgaaactgcttaaagaatgtagtgagaagatagataccgttgaaaaaagaatgttaatgatgaatgaagatggtgggctgagtgaattttaaagaagaattagaacaaagaaccagagaagcggaagaaattatcaaaagctatctgccaaaagaagagggctttgccaaaaatatggcagaggcaatgaattacagcatgctttccggtggaaaaagacttcgaccggtatttatgagagaagtttacagtatgtttggcggaacagggaaagtgatagagccttttatggcggcaatggagatgattcatacccattcgctgattcatgatgaccttccggcacttgacaatgatgagtaccgaagaggaagaaaaaccacccatgctgtttatggagagccagcggcaattcttgcaggagatgcacttttaaattatgcttatgagacggcatttcgtgcatttgacttattagatgagtcagatatggaagaatggaagcgtgtggcaaaagccttatcaattcttggaaagaaaaccggaattgacggcatgcttggcggacaaagcgtagatgtagaaaatgacaaaaaagagcaggaactggacagggaaatgctggattatatttatgaaaataaaacatctgcattaattgaatgtgcaatgacaatcggagcaactcttgcaggagcgagagaagaagagatacagaagatagaaactcttgcaggaaaaataggaattgcctttcagattcaagatgatattttggatgtcacaggtacaatggaggaactgggaaaagcagtagggagcgatgaaaagaaccataaaacaacttatgtgactctggaaggaatcaaaaaggcgggagaagatgtgaaagagctgaccaaggaggcattgaatctgcttatggaacttccgggtgaacaggaatttttaagagaactgcttctttcactttgtacccgcagaaaatagaggtgcaaaagagatgctgttagaaacaattgaaaaagaaaacgatataaagaaaataccgttagaacagatgcctgtgctggcacaggaaatcagagattttttattagagtccttaagtaagaccggagggcatctggcttctaaccttggggcggttgaacttaccatggcactgcattatgtgttttcacttccaaaagacaaaattatctgggatgtcggtcatcagtcttatacacataagattctgaccggaagaaaggatggatttaaaaatctgcgtcaatatggagggttgagtggatttcccaaaagggaggaaagcccttgtgatgcttacgataccggacacagttcaacttccatctcagcaggagtcggctatgtctgtgcaagcaaagtaagtggagaagagtatcatgtggtatcggtaatcggagatggtgcgctgaccggcggaatggcctatgaagctttaaataatgcagcgagcttaaataaaaattttgttatcgtattaaatgataataagatgtcgatatcggaaaatgtgggcggaatttcaagctatttaagtaatctaagaacagcagaatcttatacggatttaaagagcgaagtcaaaaagacattaaataaagtaccgggaatcggaccggtcatggtacaaagaattcataagacaaaagacagtattaaacagcttatgattccaggaatgttttttgaggatatgggaattaaatatttgggaccggtaaatggacatgactgtggaagaatgattcagatttttcaggaagcaaaaaaagtaaacggaccggtgctggtgcatgttcagaccgaaaaaggacgaggatatgaaccggcaagaaaacacccggcaagatttcatggaacatctgcatttaatctggagcatgggattccattaaaaaccgggggaaaggcaaattatacagatatcttttcgacagttatgctaaagttggcagacagaataccaaatcttgttgctttgacagcggcaatgccggacggtaccggtttaaaacggtttcgaaaccgctttccacagcgcttttttgatgtgggaattgcggaggaacatgcggtaacctgtgcagcaggaatggcacttggaggcatgataccggttgtggcaatttattcttcatttcttcaaagggcagtggatcagataatcgaagatgtttgtctgcagaacctgcatgtgatttttgcaatagaccgtgcagggcttgtaggaagtgatggagaaacccatcagggatgttttgatttatcgtatctgtcgatgataccgaatatgacggtgttagcaccaaagaacaaatgggagctttcagatatgttgaaatttgcagtgcgttatcaaggtccaattgcaattcgctatccaagaggagaggcttatgatggtttagaagaatatcgtgagcctatggtttatggaaagagtgagttgatttttgagggcgaagaaacggcattgttgtcagtaggcagtatggtagagacggcagtagaagtaagggagaaattaaaagcagacaaaatcaatgcaactttagtcaatgcaagatttataaaaccactggataccaaaatccttgaccggcttgcattgaagcataaaaaaattgtgacaatggaagagaatgtgaaaaatggtggatttggaatggcggtttccgagtatatgcaggaatatcatccagaggtaaaagtgcagattatcgctcttccggatgcatttattacacatggaaatccaaaattgttaaaagcaaaagccggaatcgatgcagattctatttatggggcaatcaaggaggcagagaagagatgaaagaacgtctggatgtactgttagtaaaaagaggactggcagtatcaagagaaaaggcgaaagcagtcattatgtcaggctgtgtttatgtagagaatcagaaagaggataaggcaggttcgatgtttgcagatacagcaaacattgaagtgcgtggcaatactttaaagtatgtaagtcgtggtggattaaaactggaaaaagcgatgaataacttcggagtaacccttcaggataaaatctgcatggatgtaggttcttctaccggtggttttacagattgtatgcttcaaaatggagcagtaaaagtttatgcaattgatgtaggacatggtcagttagactggaaattaagaaatgacgagcgggttgtctgtatggaaagaaccaatatccgatatgtgacaccggatgatttgcaggagccggcggatttttcttcgattgatgtttcttttatttctttaacaaaagtactgcttccggtttatcatctgttaaaatcaggtggagaagtggtatgcctgattaaaccgcagtttgaagcagggagagaaaaagttgggaaaaaaggcgtagtcagagatgcgaaagtacatcaagaagtcattgagaaagtaatggagtatgcaaaaagtattggatttgcacctcagcaccttgaattttcaccgataaaaggaccggaaggaaatattgagtatctgcttcacattgtaaagacagataccgaaaatccggtaaaagagcaggagctttcaattcagaatgtcgttgctctggctcatgcggagttggataaataatggataaattttttattattgcaaacagacaaaaagataaagaattaaagacggcaagaaaagtcgaagcgtatttaaattccaaaggaaaatcttgcattttaagagaagaaacatcggaacaaaaagccagaagcaatcattatacggatgtggaaaaaatcccaaaggatgtggagtgtattattgtgattggcggagatggaacacttttgcaggctgcaagagatgtggtaaatcgtcagattccgcttttgggaattaatatgggtacgcttggatatcttgctgaaattgaccgttcttctattgatggagcattaaatcatctgatgttagatgaatatacaatagagaaacgaatgatgttaaacggaaaagtttatcataaagaagaactgattgcagaagatgttgcattaaatgatatcgtgattggtagagatggtcctttgcacgtaacgagatttcataactatgtaaatggtgaattcttaaacagctataccgcagatggaatcattatagcaactgcaactggctcgaccggatacagcctgtcagcaggaggaccgattgtatctcctgaaacaaacatcctgattatgacaccggtagcaccgcataccttaaataccagaagtgtgatttttccggcagaagatgagattacggtagaaatcggagagggaagtcagggctgtgaggcaaaggcagtagtaagctttgatggagataccaatgttccgatgcgtacggcagacagagttgcgatacgacgttccgtgaaagacacccagattataaagataagtaatattagttttcttgaagtattaagacggaaaatgaaaaactaaggagacggacagattatgaaaattgccagacattcaaaaatcattgacctgattaaccaatatgatattgaaacccaggaagaactggcagctaaactgcaggaagccggatttgcagtgactcaggcgacagtttcaagagatatcagagagttgaaattgatgaaaatcgcaaaaccggatgggggttctaaatacacagttttagagcagcggacgaatcaggacagcgaaaaatataaaagggttttgcgggatgcactgttatccatggaaatagcgcagaatattctggttataaaaacagttgccggaatggcaaatgctgccggagcagcgcttgataacatgaagatgaatgagattgtgggctgtattgccggggacgatacgatagcctgcattaaccgtacagtagacgatacgattatcttaatggaaaaaattaaaaaaattattaacacaggcgaagagagtacaaggtaaaaaatatgttgttgcatttgcatgtaaaaaatctggcactgattgatgaagcagaagtagattttacagaggggcttaatattctgactggagagaccggtgccggaaagtcaattttaattggttcgattaatctggcacttggtcagaaagcttcaaaaagcatgataagggagcatgcggagtatgcgtttgtggaactggtatttgaagcaggagagcggactgccgaaaaattgaaacagatggatattttcccggatgacggacaggttattatcagcaggaaactgacaggaaacagaagtatctgtaaaataaatggagaaacctgtacggtttctatggtaaaacaggcagcgttttatttgcttgatattcatggacagcatgaacaccagtctttattatatccggaaaagcagatggaaattctggatgcttatggaaaagaagagattcaaaagaaacgagagcaggttcagaaagattatgaaacttataaggcattaagaaaagaacttgaacagtatgagatagacgaagaacaaaaaaaacggcagatggattttctggcatttgaaatttcagaaattgaagatgcaaaattgaaagtgggcgaagatgaagagttagaggcacagtatcgcaaaatgataaatgcaaagcggattacggaaagcctttcagaagtgtatgaactgacagggtatgaaagagaaggaagttcagaacagattggcagagccgtccggcagttatcgcaggtatcggaactggatgatgacttaaaaggaatttatgaaaccctgaacgatatagatgctcttttaagtgactttaacagagagctttcttcttatctttctggtttccaattttcacaggaagagtttttggagacagaagaacgtttaaatcttctgaatcatctaaaatcaaaatatggagcaagtattgaggcagtactggaatataaacaggaaaaagaagaagaatacgaagcactggaacattttgaacagaatcaggcggaattaaaaagaaaaatagaagagcaggaaacggtattacaaaaacagtgtgaatgtttaacaaaaagtcgaaaaaaatgggcaaaaagtctggaaaaagagattatcgaaggactgcaggaactaaatttcctggatgttgcatttgagattgtgtttgaggaaaaagcagagttttcttcaaatggaaaagacagcatctgcttttttatttcgaccaatcctggagaaccgaaaagagaacttcaaaaagtagtttccggtggagagctttcccgaattatgcttgcgattaaaacgattctggcggataaagacgaaaaagaaacacttatttttgatgagattgacacaggaatcagtggaaagacggcatggaaagtttcagaaaaaatggcagtgattgcaaagtctcatcaggtactttgtattacgcatctccctcagattgcagcgcaggcagattctcattttttaattgaaaaaagtgtaaaagagctggaaactcagacaaaaatctggcgtcttgatgaagaaaaatcggtggaagaactggcaagaatgcttggtggagaaagtattactgagacggtactttcaaatgcgcgtgagatgaaagaaatggcacaacaacaaaaaaatacaagagtgaaataatagaattttcacatactaaaaagggtacacaattaacgtgtatccttttttgtatgtgaaaactgcaaaataaaagtttgcatttagaatgaaaaaagaatttatttgaaaaaaataacaaaaggatgtgattttttgaaaaaaaagtgtaattttcgtcgtcttttattcgtattattattagcagatattatctgcgcaggattttttggatggaaaatcaccgaacaggcaattccggatacggtgtatctgtccaagaaagaagaaaaaggaatttctgaattacgaaatctgccatttgtgacttatgaagatacaattcaaacttcgaaggggaatgcatactggatttcctgtaaactgtttgatacgattccggtaaaaaaaataaaagttcagacagtagaggaagataaagtttcggtttgcgggcagccggtaggactttacatggagacgaagggagtattaataattgatacaggagaaattgtacaagcggatggaatgacctgtacaccagcaaaaaatattgcaaaatcaggggattacattcttaaagtaaatggggagacaattcagacgaaaaaggagctgattgataaaatacaaaattcagagggaaaagaagtaacacttttagtagaacgggatgaggaagaaattccaatctgtattcaaccggtaaaagcgcaggatttaaagtataagcttggaatctgggtcagggataatacgcagggaatcggaacgttgacattcttaaccaaagaggggacttatggtgcactggggcatggaatcagtgatacagatacaggagctctgcttaagatttcacagggagaactttatgaggctcaggttgtctctgtagtaaagggaggcagaggaacaccaggtgagttatcgggttatattgattatagtgagggaaaaaaacttggaacaattgaaaaaaatcaagaaaatggtgtatatggaatgattggaatacaggaacaaggaaaactgcccctttgtcagatgagtattggttataagcaggaagtttgtaccggagaggctgaaattttaacaaacgtagagggagaggtaaaagcataccgtgcacagattacagaaatttttccggaacacgcagattcaaataaagcgttttctatcgaggtgacagatgaaacactgcttggcatcacaggtggaatcgtgcagggaatgagtggaagtcccgtgatacagaacggaaagctgataggggctgtgacacatgtatttgttcaggattcaacaaaagggtatgggatttttgctgaaaaaatgctggaataaataaaaagttgtaatttgtcaaaatgtcgaaaaataacagaaaagaatacttattgtagaaacaattttcttgattaactgacagacagagaatataatacaagtaatccttagaaaatggcaattcaacagggcgcccgtcgtttactgaggaaagcagcaataagtgatggaggattagaaatggaaaaattaaatgtcgcaattgcagatgataatgaaaaaatgatagacttattggagacgctcatcaaagaagataatgaattggaattagtcggacacgcaaataatggtgctgatatttatgatattattaaagagaaagaaccggatgttgtacttttagatatcattatgccaaaagtagacgggctgaccgtgatggagcgggttggaaaagattgcacaattaagaaacatccggcatttattgtagtatccgcagtcggacaggaacagattacggaagatgcttttaatcttggcgcaaattattatgtgttaaaaccattcgataatgatatgctgatttcaagaatcaaacatattcgtcagttgagagacggaagaaaagatttaagaagaattaatgcttatgaagataagaacacttattttgaacgcaatcttgagaccgatgtaacaaatatcattcatgaaatcggagttccggcacacatcaaaggatatcagtatttaagagatgccattattctttctgtcaatgatatggaaatgctgaactctatcacgaaaattttatatccgacgattgcaaagaaacatcagactactccaagtcgtgtagaaagagcgattcgtcatgcaattgaagttgcatggagcagaggaaaaatggacaccatcgatgaattatttggatatacagtcagtacaggaaagggtaagccgacaaattcggagtttattgctttaattgcagataaaatccggttagaatataaaaaataactttcaatgccagacaaaaaggagtataatcatcttaaatagacatcgaagcaaggaggaattttttggtgaaaaagattttatttgtggcatcagaagcagtgccttttataaaaacaggaggactggcagatgttgtaggggcattgccaaagtgttttgacaagaacgaatatgatgtgcgggtgattattccgaaatacatgtgtatgaaagaagaatataagaatcagcttcagtatgtaacacatttttatatggatattggttaccgcagagagtatgttggaatcatgcagatggtatatgagggaatccagtattactttatcgataatgaatattatttctcaggatatcagccttacggagatattcgatttgatattgagaaattttcttatttttcaaaagcagccttatccattcttccggttattgacttcagaccggacttgattcactgtcatgattggcagaccggattagtgcctgtattcttaaaagaccgttttcaggatggtccgttctatcagggaatcaaaactgttatgaccatacataacttaaaattccagggaacctgggatattaagacaatccgtgatttaaccggacttccggcatattactttactccggataaactggaatcttataaagatggaaaccttttaaaaggcggtctggtttatgctgatgcaatcacaaccgtaagtaatacttatgccgaagagattaagacagaattttatggtgaaaaactggatgggctgatgagagcacgtgcaaatgacctgcgtggaatcgtaaacggaattgattatggtgaatggaatccagagacagatcagttgattgcaaagaattacaatgcgaaaacatttcgtaaggaaaaagtaaaaaataaaatagaattgcaaagagaacttggtttaaatcaagacccgaaagccatgatgattggtattgtatctcgtctgactgaccagaaaggttttgacctgattgcttatgtgatggatgaattgtgtcaggataatattcagttagtggtacttggtacaggggaagaacagtatgaaaatatgttccgtcactttgcatggaagtatcagggaaaagtatctgcaaacattttctatgataatgcaatgtcccataaaatttatgcttcctgcgatgcattcttaatgccgtctctgtttgagccatgtggtttaagtcagttaatgagccttagatatggaacgattccgattgtaagagaaacgggtggattaaaagataccgtagaaccatacaatgaatatgaaagtaccggaaccggattcagcttcacaaactataatgcacatgaaatgctagcgaccgttcgttatgcagaagctgtttactatgacagaaaacgcgaatggaacaagctgatcgatcgtgcaatggcaaaagatttctcctggggaaattctgcaaaacagtatgaagaaatgtataattggttaatcggttaataaataaatcaattaatagaaaaaaggatatcccttgtcatcttgggatatccttttttaatataaatttacatcagattataagaataatggagtaaatacaacagcaacaattgtcataagtttaatcaggatgttgatagacggtcctgaagtatccttaaatgggtcgccgacagtatcgccaacaacagctgctttatgagccggacttccttttccgccatggtgtccatcttcgatgtatttttttgcattatcccatgcgccaccggagtttgccatgaagattgccattaaaacaccggttacaagagcaccggcaagcagtccgccaagtgcagaagaaccaagaatgattccacataaaagaggagcagcaactgccatcagacctggaagcatcatttcttttaaggcagcctgagtagaaatttccacacaggaagaataatccggtttgccttttccttccatgataccaggaatggttttaaactgacgacgaacttcttcaatcattttgtttgctgctttggaaacagaatccatagtcatagcagagaataaaaatggaagcatacctccaaggaagagtccgatgataacctgtggatttaagatatcaatggattccagtccgacagcctctgaataagaaacgaataaggcaagggcagtcagggcagcagagccgatagcgaatccttttcccatagctgcggttgtatttccgacagagtcaagtttgtctgtaatattacgaacggaatcttctaatccggacatttctgcgataccaccggcattatcagcgattggaccataagcgtcaattgcgattgtgattccggctgtggaaagcataccgactgcggaaagagcaattccgtacagtccacagaaatgataggaacataaaataccaattgcgataaaaaacagtggaagcatagtggaacgcataccaacagaaagaccactgatgattgtggtagcagaaccggtttctgactgggctgcaattctctgaaccggtttataatcgccggaagtataatattctgtcataataccgattaacagtccgacaatcagaccactgatgatagcgagtgctgctttcatatcaccaaagaataccttacttagtacaagtgaaagaactaatacaacggcactggaaccataagttccggcttttaatgcttttcctgggtctgcatttttgctggcttttacaaagaaagtaccggcgatcgatgcaaggattccaaatgcagcaagtgcaagagggaatacggcacccggttctttgaagtagatgacaccaagagtaattgcagatacaagagagccgacataagattcaaaaaggtcagcccccataccggcaacgtcaccgacgttatcaccaacattatcagcgataacagcagggttacgagggtcatcttccggaataccggcttctactttaccaacaaggtcagctccaacatcggcagctttggtgtaaattcctccacctacacgggcaaataaagcgatggaagaagcaccaagcccaaatccggaaatgacgccggtatcttttgtaattaagtagacaatgctgacaccaatcagaccaagtccggtcacgcacattcccataacagaaccaccggaaaatgcgatggataatgctttaggcataccggattcttttgcggctccggcagtgcggacgtttgcttttgtagcaacctgcatgccaaaataaccggcagcagaagagaacagtgcacctaaaagaaaggcgcaggcagtactccagctttttaaagcaaagcctaaaataaagaataaaagtgcaacgaagataatgagaatacggtactctgccattaaaaaggcctgtgcgccttcatgaatgtaagaagcgatttcctgcattctctgatttcctgcatcctgctttttgatgttgtttgagagtgtaaaagcaaaaagcagggcaaggacaccaacgattggtgcgagatagatcatggtttccataagtctcctttcttacttgtgtgatgtaattttctgtaaataataaaaaaatcacacaagatataaaaaaataatatttataggtatattatacggttaattcgtctaaaagacatcaaattaattcatctaaaacgtaaaaaatgacaaaaaaataattaaaaaatcaacttttcttgactttttgtaaaaaatcgaggataataaaaagcaataaatcaaaaataaatcttaagattcttaaattttttatccttagcgttcgctgaaaataatctccaaataatctataaagctgtaagcagaaaaagaaaactcattgacaattaagagaaagtatactattatatcaactatagatacgaacataagttcgctgtatataaaaaatagaataaaggagtaaaaagatggtcaaagaagataaactaaaagcacttgatgtagcgcttggacagattgaaaaacagtttggaaaaggttctgttatgaaattaggtgattccagcgtaaatatgaatgtagaagctgttccaactggctctttaagccttgatattgcattaggtcttggaggagtcccaaaagggagaattattgagatttacggaccagaatcaagtggtaagacaacagtagccctccacatggttgcagaagtacagaaaagaggaggaattgcaggttttatcgatgcagaacatgcgttagaccctgtttatgcaaaaaacattggtgttgatattgataacctttatatttctcagccggacaacggagaacaggcgatggaaattacagaaaccatggtgcgttccggtgcagtggacattgtaattgtagactctgttgcagcacttgttccgaaggcggaaattgaaggtgatatgggagattcccacgttggacttcaggcaaggctgatgtctcaggcacttagaaaactgacagcggttatcagcaaatcaaactgtgtggtaatctttattaaccagcttcgtgaaaaaattggagtgatgtttggaaatccggaaacaacaacaggtggacgtgccttaaagttctattcttccgtgcgtatggatgtcagaaggattgaagcattaaaacaggcaggagagattatcggtaacagaaccagaattaaagttgtaaaaaataaagttgcaccgccgtttaaagaggcagagtttgatattatgtttggaaaaggaatttcaaaagagggtgacgtgcttgatttggctgccggacttggaattattgtaaaaagtggtgcatggtatgcctataaggatgcaaagattggtcagggacgtgaaaatgcaaaacagtacttgagagacaatccggagattcttgaagaagtggaaacacaggttcgtgagcattacggacttccgactgagaagaagcaaacagagtctgcaaaatccgagagtaaaaaaggtgaataatggagataacgaaagtacaggctttgacaaaacagaagtatagaatatttttagatggggaatctgcttttgcggtttataaaggcgaactttcccgttatcatttagaggagggagcagtgcttcctcctgaagtttatgaagaattagtcaacagggtactcaaaaaacgtgcaactttgcgcgctatgcatattttggagcgtacggataaaacagaagcacagcttagaagaaaactggaagaaagtgagtatccaaaagaagcagtggaatctgcgattgcttatgtaacatcttatggatatttagatgacagacgatatgccgaacattatattgagtggaaaaagcagggaaaaggaaaagcgagactgaaaatggaacttgtccagaagggaatttccagagaaattattgaagaggtattagaatcgacagattttggagaaacgagagaaatgattcgtcagattatcttaaagaagcgaaagacagatattcccatgaatgaaaaagagaagcagagactttatggatttttaatgagaaagggattttcttcgtcggatattctggctgttatgcgtgaggaagaatggcggaataatacagaattttaataaaaaagttcgacaaattatacagagagaggtaatttttaaaacgctttttagttgactttttattgaaaacagtataaaattatactgttgtatttgtacaatgaaaattaaatataaggaggtgctcctgtgggaatcattgtgataactgcgattattgctgttatagttaccttagctgtttcagtgccggttactgcaaatctttctgtaaagaaaaagacagaaaaagatgcggaaacaattggaactgctgaagtaaaagcaagaggcattatagatgaagcattgaaaactgcggaaacgaaaaagcgtgaagctcttttagaggcgaaagaagaaaaccttcgcaccaagaatgaattggaaaaagagacaaaagagagacgtgcagaacttcagaaatatgagaagcgtgttgtctccagagaagaagctttggataaaaaagcagatgccatcgaaaagcgagaagcagattattcagcaaaagaagcagagttaaagaaaaaagaaaagaaaatcgacgaattacatgaccagagagtacaggaactggagagaatttccggtcttacctccgaacaagcaaaagattatcttttaaaaactgttgaagacgaagtaaaaactgacactgccaagctttataaggaattagagagtaaggcaaaagaagaagctggtaaaaaagcaaaagaatatgtggtaactgcaattcagaaatgtgcagcagaccatgtagcggaagctacaatttcagtcgtgcagcttccaagtgatgaaatgaaaggacgtatcattggtagagagggacgtaacatcagaacacttgaaaccttaacaggggtagatttgattatcgatgataccccggaagcggtagtcctgtccggatttgacccaatcagacgtgaggtggcacgtattgcattggaaagactgattgtggatggaagaattcatccagccagaattgaagagatggtggaaaaggcacaaaaagaagttgaaaccatgatgagagaggaaggagaatctgctgcacttgaagttggagtgcatggtattcatccggaattaatccgtttgttaggacgtatgaaattccgttccagctacggacagaatgctttaaaacattcaattgaagtagcacagattgctggattattagccggagaagtcggaaccgatatccggatggcaaaacgtgctggtttattacatgacatcggaaaatccatcgaccatgaagtggaaggttcccatattcagatcggtgctgacttatgtagaaaatataaagagtcccagattgtaattaatgcggttgagtcccaccacggtgacgtagagccgaattctctggtggcttgtcttgtacaggcggcagatgcgatttcagctgcaagaccaggtgcaagaagagaaactgtagaaacatataccaacaggttaaaacaattagaagacataacaaactccttcaagggagtagaaaaatcttttgctattcaggcaggtagagaaatccgtgtaatggtacttccggaacatgtaagtgatacggatatggtattgttagcacgagatatttccaaacaaattgaagctgaactggagtatccaggacagattaaagttagtgtaattcgtgaaagccgcgtagtcgattacgcaaaataagaaacagatgcagagtcaaagaaaaaattctttggctctgttttttaaccaaatcaagtaagtcccctgcttcaattgcgaaaagcaataagcaggggacttgcttgtatcaggagggggcaagccccttctgataagctgcgtagcagctatttggttatgagcaagtagcgaagcggattgcgaatatccacttgactttgcaggaaattgcttttctgtaaaaaattttttgtgttaagtataataaataaggcataccttgtatagggggaaaaaatgaaaaaaaggctttctatttttttgattctatattttgtaggctttacaattggaattctttgtacgagtctgttgaaaaaggtgacacaggagaatacagctttacttggtatctatctgaaaaatcaaaatacagaatctgttttaaatgttcaggtatttggtcacttattaaaactgagggggaaatggtttctgttttattttataggtggaatgacgcctgcaggaattgtaatggtattggcaggatgtctgtggctcggacttttagcaggctgtctggttactttatttttgatggagtatggggtcattggaatttttttctgcataggatgtgggattcctcagagtttcttttatcttccctctgttttagctctgttttttttatgcagtgagatgagtcttaaattctggaggaaaagttaccggagaaaagaggactataaggggtacgttttttttatgaccagtgcggcacttatatttttgcttgggatttttttggaaagttatgtgagtcccaatttattaagagtattatttcattaaaaaattcataaaaagttaacaatttaaaatttaccatatatggtggatgaaaaatagtggctgccgatatcttgtataaataaaaaaacataatggaaaacaggaaaaggaaccttaaaaaggggtttgatttttaatccaaaagtgatatataatccatttatagcaaatatattcttgaagtttttgtggttttgacgttgcagaaagactttgagagtgtctagaaagattagagataaaggattgtatcatgaagtgtgagatagaagagtttattgggtatttacataacacaagaggcacttctttcaatacagaaatttcttacgagcgggacttgcgcaaattggagcagtttttgaaggacaaagggatacgcagaataaggcaagtgacagaggcagaattaaacagttatgttacttatttggaacgggaggagtttgcggcttcttctatttccagaagtattgcttcaattcgtgcattttttcaatatttttttaatcagggacttattcccaaaaatccggcagatactttaaaagctccaaaagtagaaaaaaagataccggagattctttctgtagaagaagtggatttgctgcttgcccagccagatgaaaaaacaataaaaggaatacgggacaaggcaatgcttgaactgctgtatgcaacggggatacgtgtcagtgaactgattcatttatccgtcagggatgtgaacctgaaattaaattatatcagctgtagttcaatggaaaagagccgtgcggttccatttggaaatacagcaaaaaaggcagtggagacttatgtggaacaggcaagagatgtacttttaaaagaaaatgacagtcccaatttgtttatcaactgcaatggaacggcaatgagccgtcagggattttggaaaattttaaagtattatgcaaaacttgcaggaattgaaaaagaaattacaccgcatactctgcgtcattcttttgcggtgcatttattgcagaatggtgcagatttaagaagtgtgcaggaaatgctggggcattcagatatttctaccactcagatttatttaagtttgaatacaaatcgaatcaggaatgtctataaaaaagcgcatccaagaagctaaaaaagtgatgtaccaaaaaagaccgtagtcttcttttcagtggaagactacggccttttttattagcagagctctgcgattgtataaagcagtttttcagtttcatcccatccaaggcatgggtctgtaatagattttccatagacatggtttggtccgattttctgatttcccggttcaatataactttcaatcataacgccttttactaactggcggatgtctttagaaacaagacggctgtgaaggacttctttgacgatacgaatctgctgttcatattttttaccggagtttgaatggttggaatcaatgataacagctggatttgccaggtcacgttctccatacatttcaagcagaagctgtaagtcttcgtagtgatagtttggaatggtatttccgtgtttgttgacagcacctcttaagatggtgtgagtcagaggatttccttcagtgctgacttcccagcctctggaaataaaatcatgaccatgctgtgcagcaacaacggaattaagcataacagaaaagtcaccactggtcggatttttcataccaaccggaatgtccagaccgctgaccatcagacgatgttcctgattttcaacagaacgagcgccaattgcaacataagaaagcaagtcagagagataatgccagttatccggataaagcatttcatctgcagaagttaatccggtttctttaatggaacggatatgcatgtgacggattgcaaggataccggcaagtacgtctggttttgcttccgggtcaggctgatgaagcattcctttatatccttctcctgttgtacgaggtttgttggtatagattcttggaactaatacaagacggtcggcaactttttcctgaacttttgcaagacggttggtgtaatcgcagactgcttcttcattatcagcagagcaaggacctacaataaccagaaatttatcagaattgcctgtaatgacatcctgaatcagacggtctcttgtttctttcacttttttcatttcttcggttaccggagacatttctttgatttcttccggagatggaagttgtttcacaaatttaaaactcatcttaactttctcctttatctctgttcattttctgtggatattgtacagaaagtatcctatcaatgtttgattataatacagaaaaaaaggcttgtcgactgtttttgacgattttatgctttaaagttaaaaagaaatattgctttcctttcagatgctctggtaacttagttgcagagtagttcacaagcatttccctttcagaaaaagatgaagaaaaaaaagcgttaaaaatgtagtaataagttcacttaaaagcagtccccagaggtaaccgatgattccgtgggtcggaattacgaaaaaaacaaataaaagccggatagaaagacctgtcatattttgaaaaaagtaaggaccggtctgaccaagtccatttaaaattccacttaaggtacttgaaagatagagacagggacagataaatgataaggtgcggataaaagtggaagcaagttcatttttgaataaaaacagtccgagaaaatctgccagaaaaaagaagctgaatgtgaagagaaaaccaagaatcagacagtaacgaattgttttttgaatacaaagccgaatattatcataatttccaagtgcctggtgttctgcaacggaaggcagcaacatgaccgagactgcatttgtaattgcacagggaaatagaattaagggcagcgccattccatttaagacaccatatacagacagggcagtctgctgagtcattccaaacaagcgcagatgtcccggaattaaaatggattcaatactgtgcagaagattgaccagaaggcggttacaggtaagaggtgtagaaaaagccagaatttcttttaactgccgaaaaggtctgattatcttgcgaacaggctgagtggaggagtgaaaatccatgatggtaataaataaggcgaacagcatggaaataaattccccaaaaaaaagaccaaagacagcaagcataggagtgattgcgtgtccttcctgactccagacaagccagagcagataggaggcggcaacacgggcagtctgttcgattaactgagagagagccggtaaaagtgttttttttcgggcaaaataataaccgtttacgcaggagtgaaacgttcccatcggaatggagagggaggatacttttaaaagagaagtacattgtggttcaaataaaatatgtatagcaaaccagtcagcataatgaaaaagaaaaaaagtgacaagaatagaaagtaaggtagaaaaagatgtggcgattaaaaagacggctcttgcatcggagtcctcttttttggcaaatttggcagcaacaaggcgtgaaattgcagtctggatgccaccgacggtcagagcaaaacaaagagcatgaattggaaaaatcaactgataaattcccattccggtagaaccgattgtctgagagaggaatattctatacaagaaaccgattatttttgtaaggaagccggagagcgttaaaatcagagtccctttgagcatagtacgagtatgattcatggcagatttccaaaaacctttttctcaaatatattcaaaaaaccatcttgacagaacaagataagaatgatattctacttttaaatccgagtggaatagtcggaatttaaaaggatggtggttgtttgaaattatcaaccaaaggaagatacggattaagagccttgatagacctggcattatatagtgaaaatgagactgtttccatacagagtattgccagaagacaaaacatttctgacagttatctggaacagttgatgcgaaagttacgaagtgcaggactgattgtcagcgtcagaggtgcgcagggtggttataaactggcgagaccggcaaacgaaatttctgtgggagatgtcttaagggcactcgagggaagtttagaggccgtaacttgcggaggagaagacaatagttgccagggggcagatttatgtgtaaccaaatttgtgtgggaacggattaacagcagtatccgtgacaccgtagattcaattaagctgagtcagcttgtagaagaaagccgtctgatgcgggaaaaggggcagattcaggtacaaaaatgcgataattaaagtttataggagagataaagctatgaaaacaagtatctatttggacaatgcagcaacaacaaaaacagcacaagaagtagtcgatgcaatgcttccatattttacagaaaattacggaaatccatctagtatttatgatttgggaacaaaaagtaaagaagctatcacaaaaggaagagaacagattgcagaagtgcttggtgcaaaaagtgaagaaatttatttcacagcaggcggaagcgaagcagataactgggcattaaaagcaacatttgaagcttataaaaataaaggaaatcatatcatcacaacaaaaattgaacatcatgcaattcttcatacctgcgaatatctggaaaaacgcggtgcaaaaatcacttatcttgatgtagatgaaaatggtgttgttgatttagaccagcttcagaaagcaatcacaccagaaactattttaatttctgttatgtttgcaaacaatgaaattggaacaatccagccaattaaagaaatcggtatgattgcaaaagagcacaatattttattccacacagatgccgtacaggcatttggacaggttccgattaatgtagacgaattaaatatcgacatgctcagctccagcggtcataaaatcaatggaccaaaaggaattggtttcttatacatcaaaaaaggggtgaaaattcgttcctttgtacatggtggtgcacaggaaagaaagagaagagcaggaacagagaacgttccgggaatcgtaggatatggtgtagcagcaaaacgtgcagcagattctatggaagaacgtacaaaaaaagaaattgaattaagggactattttatcggaagaattttaaatgaaattccgtatgtacgcttaaacggagacccgaagagacgtctgccaaataacattaatgtaagtttccagtttgtagagggtgaatctcttctgattatgcttgatatgaaaggaattgcagcttccagtggttccgcatgtacatctggttctttagacccatctcatgtattgcttgcaattggactgcctcatgaaattgcacacggttctcttcgtatgacaatcagtgatgaaacaacaaaagaagatttggattacaccttagaccagattaaagaaattataagcagactgcgtcagatgtctcctctttacgaagatttcgtaagaaaacatcaggcataagaaaggcacataaaaaagacataagaaaagtttaagattaagataacggtaatagttaaatttgatttaagataaaagaaaaagacaggatataacggaggaataaacgatatgtacagtgaaaaagtaatggaccattttcagaatccaagaaatgtaggtgaaattgaaaacgccagcggagtaggtacagtaggaaatgcaaaatgtggagatatcatgcgtatctaccttgatattgatgatgacggaattatcaaagattgtaaatttaaaacatttggctgtggtgcagcagttgctacaagcagtatggcaactgaaatggtaaaaggaaaaagcattcaggaagcacttcaggtaacaaataaagcagttatggaggcattagacggacttccgccggtaaaagtacattgctctttacttgcagaagaagcaattcatgctgcactttgggattatgctgaaaaacatgatatcaaaatagaaggcttagacaaaccgaagtcagatatctctgagggtgaagaagaggaagattattaatggcaaaaaagaaagttgtcgtgggtatgtctggaggagtagattcttccgtagcagcatatcttttaaaggaacagggatatgatgtcattggtgtcaccatgcagatttggcaggaagaagaccagtttacgcagcaggaaaacggtggctgttgtggattaagtgcggtagatgatgcaagaagagtagcccagatgcttgaaattccgtattatgtcatgaatttcagaaaggaatttcagaaaagtgtcattgactattttgtcaaagattatttagagggacgaactccaaatccatgtattgcatgtaaccgctatgtaaaatgggaatctttactgcaaagaagtatggaaataggtgcagattatattgcaaccggtcattatgcgaaaattgcacagcttgaaaatggacgttatacgattgcagtgtcagatgctgttggaaaagaccagacttatgctttgtataacctgacacagtatcagctttctcatactctgatgccggtaggtgcgtataataaagatgaaattcgccagattgcagagaaaatcggacttcaggttgcacataaaaaagacagtcaggaaatttgttttgtgccggataaagactatgctggctttattgaaagaagcacaaatcggaagataccaaaaggaaactatgtgctggcagatggaacggtaatcggagaacacaaaggaattacgcattatactattggtcagagaaaagggttgaatcttgcgatgggccatccggtatttgtcacaggaatttgtccgaagactaatgaagtcgttattggggaaagtgaagatttattcaaaaaagaattagtctgtcaaaatattaactttatggcaatggaagatttgcctaaaggagaagaaagacgagtgctggcaaaaattcgttacaatcatcagggttccatgtgtaccatcagaagaaccggtgaggatgagattacagcaatttttgatgagccacagcgggcaattacccctggacaggcagttgtattttatgaaaatggctatgtagccggaggcggaacaattatcaacaatacagtaaattagtacagcgtactaaaaaatcgggcagggctgataaaggctctgctcgattttaatttataattatgcaattataatggaaaaaatataggttttcgtttttcaaaaaccgtataataggaaaagccacattgctttaaaatatctactgcacgttcaaattcataagcaatatactgtgggacatgtgcatcagaaccaagagtgataatttccccacccagttcacggtagcgttttaagatttcttcggtcggatttggatgaccaagaccgtatttaaagcctcctgtattacattccagaccgatgtttttatcgacaagaacacggagaatttcgtcaatgatttcctgatagttctgataagaataataaagatttttgtttggaccgtagcgtacaacgtaatctatgtgtccgcaaacatcaaagcaggaatattttttgacattttctaaaagacaggtaaaatatcgtaagtaggcctccttttcactgcggttttcatagaacacagattcgtaagggtcgagccggtctacaacatggacagaaccaatgacaaaatcaaacggataagagtttacaaaatcggaaagctggtttccaagttgaggctgaagtccaagttcaattccaaaacgaatgtgaatctgttcctgatattttttagcgagtgtagaaagtgtctgctgataagcgtccatgtctacgagaaaatcaaactctccaggtgggaaatccaaatcttgatgttctgtaaaacacatagaagaaagtccttttgaaatggctgtttgaatcatttcttccatgggagtgtcgctatcactggagaaagatgagtgtaaatgtgagtccgaatacataaaaaaagccctcctttggttagtttttaacttgatttttgtaaaaaataaaacaaatttacttctattatataggaaaggttggcaaaagtataggaaagatgaaaaactggaataaatattcaaattggacttgaatttttgtccaaaattaggtacaatatgaaacaggttgatgtttctttaacaatctttagaaacttcacgttaaacaaacacttttaggaggaatgaatatcatggcagtaaaagtagcaatcaatggttttggacgtatcggacgtcttgctttcagacagatgtttggagcagaaggatttgaacttgtagcaatcaacgatttaacatccccgaaaatgttagctcacttactgaaatatgactcaacacagggtaaatatgagaaagcagatacagttacagcaggagaagattccatcacagttgacggaaaagaaatcaaaatctatgctaaagcaaacgctgcagaacttccttggggagaaatcggtgtagacgtagttctggaatgtacaggattctatacatctaaagaaaaagcagaagctcacttaaaagctggtgctaagaaagttgttatctctgctcctgcaggaaatgaccttcctacaattgtttacaatgtaaaccatgaaacactgacaaaagatgataacatcatctccgcagcttcttgtacaacaaactgcttagctcctatggcaaaagcattaaatgacctggctccaatcaaaacaggtattatgtgtacaatccacgcttacacaggcgaccagatgactctggatggaccgcagagaaaaggcgacttaagaagaagccgtgctgctgcagttaatatcgtaccaaacagcacaggtgctgcaaaagcaatcggtctggttattccagaactgaacggaaaattaatcggtgctgcacagcgtgttccaaccccaacaggttctacaactatcttaacagcagtagtagaaggaacagtaacagttgaccagattaacgaagctatgaaaaacgcttctacagaatccttcggatacaatacagatgaaatcgtttccagcgatatcgttggtatgagatatggttctctgttcgatgctacacagacaatggttctgcctctggacaacggaacaacacaggtacaggttgtttcatggtatgataacgaaaactcttacacaagccagatggtaagaacaatcaaatacttcggaaaattattagcagaataattttattcgctgaatttaagaagaataaagactcagtcaaggggtccggtcttttgttggaccggactccttttgtcattttatggggaaaatatcctgtaaatttgtccattatttgacatattttatgttaaattcagactacaaatacagtttaagaacggacagaaaataataatttatttaaggaggcatcatttatgctgaataagaaaacagttgatgacatcaacgtaaaaggaaaaaaagtactggtacgctgtgacttcaatgtaccgctgcaggatggaaaaatcacagatgaaaaccgtctggtagcagctcttccaactattaaaaaactgattgcagatggaggaaaaattattctttgttctcatcttggaaagccgaagggagaaccaaaaccagaattatctcttgcaccagttgcagttcgtttaagtgaattactcggacaggaagtaaaatttgcagcagacccggaagttgttggaccaaatgcgaaagcagcagtggaagcaatgaacgacggagatgttattttactggaaaacacacgttatcgtgcagaagaaacaaaaaatggtgatgaatttagtaaagaactcgcatccctgtgcgacgtttttgtaaatgatgcattcggaacagctcatagagcacactgctcaaatgtaggtgttacaaaatatgtagatacagcagttgttggatacttaatggaaaaagaaattgcattccttggaaatgcagtaaacaatccggaaagaccattcgttgcaattcttggtggagcaaaagtatccagtaaaatctctgtaatcaataaccttcttgataaagtagatactttaatcattggtggtggtatgtcttatactttctctaaagcattaggcggacacatcggaacttctctttgtgaagatgattaccttcagtatgcacttgacatgctgaaaaaagcagaagaaaaaggcgtaaaactgcttcttcctgtagataaccgtatcggtgatgcattctctaacgactgcaacatcaaagttgtaaaacgtggagaaatcttagacggatgggaaggcatggatatcggaccggaaacagaaaaactttttgctgaagcagtaaaagatgcaaaaacagttgtatggaacggaccgatgggatgttttgaaatgccaaattttgcacatggtacagaatctgttgcaaaagcattggctgaaacagatgctacaacaatcattggtggcggtgactctgctgccgcagttaacattttaggttatggcgacaaaatgactcatatctccacaggtggtggtgcatctctggaattccttgaaggaaaagaacttccgggcgtagctgctgcaaacgataaataataacattttattaatatctgttagagaaaaaaggagataagaaaaatggcaagaaaaaaaattgttgctggtaactggaaaatgaacatgactccaagtgaagcagtaaaattagtagaaactttaaaaccattagtaaagaatgaagaagtagacgtagtattctgtgtaccggctatcgatatcattccggttgtagaagcagcaaaaggcacaaatattcaggttggtgcagaaaatatgtactttgaagaaaaaggtgcttacacaggagaaatttctccaaatatgctgacagatgcaggcgtaaaatacgttgttttaggtcattctgaaagaagagaatactttgctgaaacaaatgaaacagtaaacaaaaaaatgttaaaagcatttgaacatggaattactccaattatgtgctgtggtgaaactctggaacagagagaacagggcgtaacaatggatttcattcgtcagcaggtaaaagttggatttatgaatgtaacagctgaccaggcaaaagaagcggttatcgcttatgaaccaatctgggcaatcggaacaggtaaaacagctacaacagaacaggctcaggaagtttgtgccggaatccgtgcatgcatcgctgaaatctatgatgaagcaacagcagaagcaatccgtattcagtacggcggttctgtaaatgcaaaaacagcaccggaactgtttgcacaggctgatatcgatggtggtctggtaggcggagcttctttaaaagaagatttcggacagattgttaattacaataaataattagttagaaaaaaataaaggaatccccgtatcttggaaaatatttgaaaagatacggggattttttataacccttccaaattaaatggtggggtatattcttcttttgcactgcttttttcctgcataaaaccatctacaagtccaagtgaaatggcttcttttaaaacagattcatattcataagtagtaattctgcggttcagttccggatattcatgacttttataaaagggtgtatactgacttaaaagactgataagatagcttttgtcaggaagcgcttcttttatccagtgaagcagggtgatagagtcttttcgacagtttggaagtacaagatgccggataattactcctttttgcaacattccgtcggagtcaaagacgggagcgcctgtctgctctatcataagtttgatggcgcatgaggcaatttcaaaatagtcttctgctttagaatattttctggaaagttcagagctgaaatatttcaaatccggaagatagatatcaacataaccttttaaaagccggatggtttctggtttttcgtatccactgctgttatagacaatgggaattttaagctgattttttaccaggtcaagagcatttaaaatagatggaagatattgagtagcagtaaccaggttaatattatgtgcgccctggttttgaagttcaagaaaaatccgggcaagtttttgttcggaaatttctttgccgtaagccgcactgctgatcctataattttggcagaaacaacagcgaagagtacagccggaaaagaaaattgccccactgcctcttgtaccgctgatacagggttcttcccaatgatgaagggcagcacgggcagcctttatctgagaagaggactgacaaaatccaaaagacgaagtccggtcaatgtgacagtttcttgggcaaagtgaacaattttcataaattttagaataattcataatcaaaaattctcctgtaaacttaaggtatcttaatattaatgaaatttctctgaaatttcaagagaagctggaaaaagtctttctttttgtcaatttttggggtaaaatagggtcgattataattataattgagaggactaaaaggggtaaaagagacaaaatggaagaaacacagggaaagaaaaaacataaagtactaaaaagagtgctgattggactggtgattctgattttgcttggtctggcggccgcttatattgcgattggctattattatcaggataagttctatgaaggcacaataataaatggaacagactgcagtaatcagaatgtagcttatataaaagacattgtaaaaaaagaggcggaagtttattctcttacgattaaagaacgtggagatacacaggatatgatagatgcttcagatattcagattacttataaagatgataatgaaattgaaacaatcatgaagcagcaggatgcatggaaatggatttttcgaattggaaaagacaaaaattataccgtgagtcaggaaaactcttatgatgagacgagtcttgagtcttatgtgaatcagatggcatgtatgcaggatgcaaatatgacagctccacaggatgcgtatatgaaagataacggaagttcttatgaaattgttccggaagtagaaggaaatacactggataagacaaagaccttggagactattaaagaagcagtagataaacgtgaaaaagaagtttctctggaggacgcaggctgttatgtagagccggctgttcgtcagaatgatgaaacattgaaaaaagaagtggaacagttaaataagatgacatctgcgcagtatgtgcttgattttggctctggacaggaaacagtcgatagaaataagcttcagtcctggttaaaagaagatgaggcaaatcatacttattcgtttgatgagactgcagttaaacaatatgtcattgatttatcttctaagtataatacggagggaaaagcgagaagttttgtgacaagcggaggtcagacggtaaatttaacgacaggagattatggataccgtttatggcaggataagacgacagagtcgcttttaactgctatgaacagcggagaaagccagaccgtagaagtaacctggttgtataaaggacagacacacgaaggaaatgaaattaacggaacttatgtagagatttccatttctgagcagagaatgtggttctataaaaacggaagcctgattgttgacacaccagtcgtaaccggaaatccaaataccggacatgcaacaccggcaggtggtgtctggaaattaaaagacaaaaaaagtccgtttacattaacggcatacaatccagatggaagtcagcagtatgcagagccggttacttactggatgccatttaacggtggtgttggaattcatgatttaacaaagagaactgcatttggcggggatatctatctgacaaatggttcccatggatgtgtcaacacaccgcttgatgcagtagcgacaatttataataacatagaaattaatacaccgattgtggtttattaataatttattaataaaaagaaagagaacgattttgagctggtcggagtcgttcttttttatcggaattttaaatgttgaaattctgctttaaaactggtataatgcattaggctgaatattaatacatcatgaggtaaaaatcatgaataaataaaagaaggagaaaacaaaatgaagaaaaaattatttgcattagtgttagcttctgttatggcagtttccatgacagcatgtggagaaagtaaatccgcttctgataacagcggttctgcgaaaagcgattccgcaggaagcagtaaaggagtaaaagtaattgatatcgacctgacaaatgaagaatatgcttttggtgtagataaagaccaggaagagcttttaacacaggtcaatgatttcatcggaaaaatcaaagaagatggaacattagatgacatctgtcagaaatactttggcggtggagaaccgacagcagtaaaatcagcacagcttgatacttcaaaagatcagcttgttgttgcaacaaacgcagcatttgagccatttgagtatacaaagggtgaagattactacggaatcgatatggaaatcgcttctatgttagctgatgaattaggacaggaactggtaatccagaacatggattttgatgcagtgtgcctttctgttggacagcacaaatgtgatattgcaatggcaggtctgactgtaaatgaagaaagacaggaatatgtaaacttctcagatacttattatcaggcatctcagcgtctgattgtaaaagcagatgataccacatttgatgactgtaaagaagcagcagatgtagaagcattacttcagaaaactacttcatctgacaagattggtgtacaggcaggaacaaccgcacagtactatattgagggaagcgatgactgggattttgcagggcttccggctgaatgtgtacagtacaaaaatggttctcttgcggtacaggacttagtaaatggaaacctcaaatatgtaattattgatgcggcaccggctgcctgcattacagaagcaattaatgcaatgcagtaaaaaattttcctgtagataataaaaaagaaacaggaagcgaaacagataaactaaaaaagcgggcagaatttcgtccgcttttttctttacaaaaggtgataagatgggaaattttggacagaagattgataaatttattgaaatttttctgcagcagaacggatatgtaaaggtagtacagggacttcaaaatacactcctgattgcaattaccggtttgattattgggattgtaatcggtactttgattgcgactgtgcgtgtgctgcccaaatataaacgtctgccgaaagtattaaatgcaatttgcagtgtatatgttagtctttttcgaggaacacctatggtagtacagctgctggtattttattatgtgcttctgccgattattggggtgcatattaccggtgttcaggtggcaatggttgtatttggattaaacagtggcgcttatatttctgaaattatgagaagtggtattcagtctgttgactccggacagttagaagccggacgcgcagtcggattaagtttcggtgttacaatggtgaaaatagttattcctcaggcggttaaaaatattctgccaacgctgggaaatgaatttatttctttgattaaagagacttctgttgtaagttttgtcggtgcggcagatttatatgtagcatttagttacattggaagcaatagttatgaatttatggtaccttatcttgtaatggctatgatttacattgtattggtgttaattatttcactgttgattaaactgttagaaaggagcctgaatagaagtgatagacgtaattaatctgaaaaaaagctttggtgaaaccgaagtattaaaagatatcagcgtaacgattaataaaggtgatatcgtggttgtcttaggaccttcaggttctggaaaaagtacttttttacgttgtttaaactgtatggaagacccgacaggcggaagcattatctttaatggtgtagatattgctgatataaaagtggatattaatattcatcgccgtcatatgggaatggtattccagcattttaatctgtttaataataaaacagtaattcagaatattatgcttgctccggtctatgtaaaatgtcaggagcttcgtaaaaataaaagaaaaaatatcaaaatccgaatcaaaaatttattttccaaacaaaaagaagaattaattccgattacgacatccaaagcagaaattcaaaaagaagcaaaagagcaggcaatgaatctgttaaagagaattggtctggaggacaaagcagatgtgtatccgtctactttatcaggcggtcagaaacagagagttgcaattgttcgttctcttgcaatgaatccggatgtgattttatttgatgagccgaccagtgcacttgaccctgaaatggttggagaagtattagacctgatgaaggcacttgcaaaagaaggcatgaccatgattattgttactcatgaaatgggatttgcaaaagaagtggcaaaccgtattctgtttatggatgagggatatattttagagagtggttctccgaaagagttttttgaacatccaaagagtgaccgggcaaaagaatttctttcaaaagtactggcataaaagaattcagaaaaaatggatttacccaaaatctgattcgtgctataataagttactgtgagaaattaagacagacaaagcagaaaaagtgatagaaacagaagggagaaattatgagtaaaaaaccaaccgtattaatgattcttgatggatatggactcaatgatagatgtgaggcaaatgcagtatgtgaagccaaaactccgattatggatcagttaatggctcagtgcccgtttgtaaaaggaaatgccagtggtatggcagtaggacttccggaaggtcagatgggaaactcagaagttggacatttaaatatgggcgctggtcgtattgtgtatcaggaactgacaagaattacaaaagaaattcaggatggagatttcttcaaaaatgaagcactgttaaaagcagtaaaaaatgcaaaagaaaataattctgccctgcatttattcggattattatctgatggtggtgtacacagccataacacacatttatatggactgttagagctggcaaaaagagaaggactggaaaaagtatttgtacattgcttcttagacggacgtgacacaccgacaacaggtggaaaagaatatatcaaagaattaaatgacaagatgaaagagcttggtgtcggtcaggttgcgacagtagtaggtcgttactatgcaatggatcgtgataaccgttgggatcgtgtagaaaaagcttacaatgcaatgacaaaaggcgaaggtattttagcagagtgccctgtatgtgcagtaaaagcttcttatgaagcagaaaaaacagatgaatttgtagagccgacggttattgtaaaagatggaaaaccagttggaacggttcaggataaagattctgttatcttctttaacttccgtccggaccgtgcacgtgaaattacaagagcattttgtgatgataactttgaaggatttgcaagagaaaagagactggatttaacttatgtatgctttacagagtatgatgtaacaattccaaataaagaagttgcattccacaaagtttctatcgaaaatacatttggagaattccttgcagcacacaatatgaaacaggcgcgtattgcggaaactgaaaaatatgcgcatgtaacattcttctttaacggtggcgtagaagaaccgaatgaaggagaagatcgtattttggtaaaatctccaaaagtagcaacttatgacttaaaaccggaaatgagcgcttatgaagtatgcgataaactgacttctgcaattcgttctaaggaatacgatgtcattatcatcaactttgcaaatccggatatggttggtcatacaggtgtggaagcagctgcaatcaaagctgtagaagcagtagacgagtgtgttggaaaagcggtagatgcattaaaagaagtagacggacagatgtttatctgtgcagaccacggaaatgcagaacagttaagggattatgagacaggtgaagtatttactgctcatacaacaaatccggttccatttattctggtaaatgcagacccggcttatggattaagagaaggtggctgtctggcagatatcgctccgactctgattgaactgatgggtatggaacagccgaaagaaatgacaggaaaatctctgttaattaaaaaataaaattttagattttgattgttaattcaattataagacctcaggagatggaggaaagtccttctatctcttgaggtctttttcaagtctttatttattgcttgtgaaaaaaagattcctgacagatataaaacttttttagagaatcttctaatttaggagagtatctgcgtttttactgaaaataagtgaaattgcctggaaagtatttagtaaatattccgagttgtttttttaaaacagatatgttattatttcattacacttcagatacagaaaaaatcaagtctgtatgtttaatcctgaccattcggtcaaaaatttcaacttttcaaaaatacaatagtgcatgaatatacagaaaaaggaaagttcgaggattttttacgcttttttctgtgtagctatgcggaaaggggtaattatgtcctggagaaaatgtagaaacaaactgtttgccttaggtctttctgccttgatgtggggaaataccttctcaggagctgtctgggcttctgacttggaaatgcaaaatacaaccgtgcaggagcaggaaaatgtaatggagggagagttacaagaaaaatcagaaatacaagaatcagggtcacaagacacagatgagtcaggaacaaaaatgccggaatcgaagatatcggaatcagaaatattagaaacggaaacttcaaaagagacacaagaatcaaaattaaagcaaaaagaggaagtagaaaaagccggattagaaaaagaagaattaaaagaaaaatttgaacaggacaaattgttagaagaattagaaccggaactggttgactcaggtctctatgaaaaaaatcaagcatttcatttatttagtgcgacaagcagtaaattagaggtgaaatggaatgaatcctttgccagttttgattctggtctgatgagcgccaatgataagatgaacagttcgattaagtatgtggcagctacggataaaaataatccggatttaaagggaaaacaacgtgcggtatactgcctgcagtataataaagatggcccacttggcgatgtgagctggaatggttctggcagaattgcgccaagtcttgcatatcttctatattggggatgtcgttatattggagaacagagtgtctggagtggttatcagaccggatatggctggaaatatgattatatggcaactcagtatgcaattcatatcgtaaacaacgaatattctttaaatacattttatagtcatctcttaaatagttcgaaaaaagaatccttttataaaatagtaaaaaaaatgacagaagatgcaataaatcctgtctattataatccgtttgaagatggatggcagaattttaaatattcgttatccgatacttctgtgacatggagtgcgcagagttataacggaaaagcaggatatatgacaaaatggatttctcagaaattaaatgatggacaggtaaactgcaatgaatatattcagtcacgaaaaattacagtagaccataatgcgacagtcatttggaaagacagtggagattcttctgattttcgactttggattccgttgtctgtttacttggaattacaggcagaaggaggaacgataacagcttctgtaaatggaacgcattccgcatttctttcgggatggaattatttaagtgtcagtaacccggatgattttcaaaaagtaacactgttagaaggtggaggaagaaatgtaggacattcagcaaaagttacagcaacagttccaaaaaaagatgtaaaatgttacattgatcttcaaaaactggataaagaaaccggactggataaaccacagaaaaatgcgagtctgaaaggtgcggtatatgaagtccgaaacgcaaaaaatattgtagcagacaaaatggtaacagatgaaaatggaaaggcaacgagtaaggcactggagatagggacttataccgtaaaagaaattgaggcttcatcagggtatgaactggatacacagacttacacagtaacattttccaatacagatgtaaatcagacaatttaccgtgctgaggtgaaatcacaagaacctgtccatgttccaaaagaagtttccattgaactggaaaaagaaatcttagaaaaagagattaattttgcaaatggagaaccggtgtttttatttgaagtaagagggacgaaagtggatggcacagaatgtgtttatcataaagcggtttcgtttaccagagagtatgtagaaaagaataaaaactctgatgggacaattcgtgcaaaagtgacgtttgaacatctaatggaaggaatttatacggcaaaagagataaaagtgatgcggtatgtcttaaaagacatcaaagaaatttcaggtggtgtcagaaaaggagagacggtcgtatttgatttaaagcaaaatgaaaaaggaagtgccgtatttgtaaacgagaaaaaggaatggcaggactggtctgatgacagttattgtgaaaatgtgattccggggaaagcaggtgatgcaaaatgagaatcaaaatgaaaaaaagaacaggtagaaaagagaaaatatacaagaaatacagccttttgtggattagtgtaattgctttagttgtattggatatcagtgttgcttctgtttcagcttattttagtgacagagaagaaaagaggaatcgaataacggtaggagacagtaatattgaaattgttgaagaatttgaccctcctgaaaaaatcgaaccaggaagtcattttataaaaaaagtctgtatgaaaaatctgggaaaatcggactgttttatccgatgccgtctggaattaagttcagaagagattcttccgtaccttgaatttgatatagataaagcaaagtggagtcttgaggaagatggatattattattatcgggaagcagtagaagtgaaaaaacagaccacaaatctgctggaagagattcagataaaagaaaatgctccatcagaagtgacagagaaaggattttctgttttagtttatgcagagtcctatcagcagggcaattttgaaaaaaatcaatggaaagaagcttgggaacattttgaaagaaatcagcatgcaaaggttttaaagatggacaatcaaacagtaactgcgtctgcttcaggtaagacaattcagaatacagaacaaaaagcagtatcaaagctttctaaagcagatggtgaagtagatattgagttaaaagagtatacgttggatgaaaaaggaaaagaaacagcgtggaaaaatctgtcagatacacttccggggcagaaaattgtaaaaatcccaagagtaaccaatgtggcgtcggagtgtgaaattcgggtaaaaatagaaatggtaatgggagaagaagtagaaattccgattacagttgatttgcttgaaggaatgtccaaagattggagttatgataagacagatggatattattattatagaaaaaaactgaaaaaaggagaatctgtggatatatttcaaggattcagaattccaccagtatgggatacaaggtatacagaaaataaagcaattaaaaaatattatacggaaaacacagtagatgtggtagtaaccgtagaagcaattggagaagaacagcaagaacaggaagagaaatggcagggagaaaaaacagttgtaagttctgtgaatgccccaaaaacctcggatgagacaaaaaagatgccattttttttcgcaatagcttcggcagcaggagtcatacttatctatttctctttaaaaaaggacaaaaacaatgagacaaagatttgaaaaaatgctttatttatcaggtagtattctattccaaattcttttgataggtcttgttatcaatctggcaggctgtgtcgcagggattaaaccggtggctgtaaaaagtggttctatggaaccggcagtcaaaacaggcagtatctgctgggtaaattttaaggcggataaatcaaaacttggaacaggagatatagttgcatttgaacggggagacggacaactggtattacatcgaatcgttcaatgcaccaaaaaaggattcattacgaaaggagatgcaaatgaaacacaagacataggagtggtcagatgggatcaaattaaaggaaaacaactctttggactgccatatattggttttttatttctaagaacagaaaaacagatggcggtttcacttctcatcggcagtttgatactgtttagtctatttgtaattcaaaatcaattcaaaagacgaatctgaaaaacaaatctaaaaaacaaatcaaaagaaattcaaagaaatacaagtcaaattttaaaatcactaaaattaaaaaatttataatatctaaaaaggagaacagattatgagaaaaagtaaaaaaatgacagcaggaattttaggtgcattaacactggttatggtaacaggaagtgcaatggcgtactttacagacagcgagcaggcaaaaaatcatattacaatcggtaaagtagacatttcgctgacagagccaaactgggataaagttccagataaagagaaagaaaatattgttccgggaaaagaattggtaaaagacccaaccattacaaatactgggattaatgatgcatttgtatttatgaaagtgactgtgccggcagcggaattagttactgcaaatgaagatggaacaaaaaatgaaaaagcattaaagcagttatattcctgggagattaacaaaggatggattcagttaggggatgcaaaagcagtaacagaaaatggaaagacaactgcatttgaatatatttatgcttatggaagtaacgcatcttgtagtgcacttgcaaagaacgtatccacatctgctctttttgataaaattacatttttaaatgtaattgagggacaacaatttgcagatggaacaggattggaagaatcggaaactgaaatcaatgtgcaggcatatgcaattcagacaactgatttaacttcaaatgatgtgacaacaccttccgcagtatggcaggtactggcaaatcagaatcagctgtcttaattcatacatggaacgtagataagcattccctcgcttcaagcttgcatataagaaaattatttgacatcaatatagcagttattcgattatgagcaagtagtgaagcggattgcgaatatccgcttgacttatactgcactggaaatttgactttgacttaaattagcatagttttaagaaatcaagagaatactaactgtgaaggaatgtaaaaatacaggaggtattcaaatgaatcgatacttgccaatacgaagagtatatgcacgagaagttttggactccagaggaaatccgaccgttgagacggaaatcacggtgggagaaggaatcataggaagagatggtatcacaggcagagcgattgttccgtccggagcatcgacgggaaaatttgaagcggttgaactgcgtgataaagaaaatcgttattggggtcttggggtacaaaaagcggttaatcatatcaatagggtgctggcagaagaaatcttaggggagaatgcattgaatcaatgcagaatcgataggattctaaaagaagcagatgcaacagaaaataaatccaatatgggtgcaaatgcacttttaggaatttcccttgctgtggcgaaagcagcagcaaaagcaatgaagctgccgctttatcagtatcttggcggaacttatacgacacagatgccggtaccgatgatgaatgtattaaatggaggaagacatgcggataatacggtagactttcaggaatttatgattatgccgaccggagctgaaactttcaaagagggacttcgtatgtgtgcagaagtgtatcagaagttaaaacaacaactaaaagtaagaggattatcaaccggagttggagatgaaggaggatttgcaccgaatctggcgaatacaaaggatatctttttgattttaaacgagtctgttgaacaaagtgggtatcagattgggaaagacatctgttatgcaatggatgcagcagcgagtgaattgtatgattcgaagcgaaaacagtattattttcccggagaatctaaggcgatgcaaaaagaaatctatcggacaacagatgagatgaccgcttattataaagaattaacgaaagaatttccaattgtatcaattgaagatgctttggatgaagaggactggcagggctggaagatgttaacggatgaacttggaaagaatattcagcttgtcggtgatgatttatttgtaacaaattcggaacgtttaaaaaagggaattgaattaaattctgcaaatgcaatcttgattaaagtaaatcagataggaacgttaactgaagcaatggatgcagttcagactgcgcaaaaagctgggtatcgtgccgtgatttctcatcgttctggtgaaagtgaagatacatttattgcagatttggcagttgcctgcagtgcaggacagattaaagccggagcaccctgcagagcagaacgaacagcaaaatataaccgattactgcaaatcgaagatgaattgaaacaagaagccagataccgaaatccatttgcggaggaatccctaaaaaagagttgaaatctccgaaatactatgttaaactgaatatgtttagcgattaggaggtgtacgcatggagattttgagaatagttttaacggttttattcgttattgattgtataggattgactgtgattattctgatgcaggaaggcaaatctcagggccttggaacaattgcaggcatggcagatacctattggggaagaaataagggacgttctatggaaggcgctcttgtaaaagcaaccaaaattatgggaattctgttttttgtattagctttagttttgaatctgaacttttaaaaatgacactcttgcagtcatgcaggggtgtcatatttttatcttataagaaattgtgtcctatgaaataaaaaaagttccgcggggttcgtactgcggtgaatgggaaaagtgttgcttagtaaaccgatgcaggcggagaagcaagagaggagcgaattttgaagaaaaattataatttgaagaaaagaaaaaaaatgctttatgatgtaatgtgctgtaaagaatatactccgatgagggcaaaagatatggcagttttacttcagataccggcaggaaagcgagaagaacttcataaaacgctggatgctttattagaagaaggaaaaattacggttaataaacgggggcgttatgaagctgtaagagaagaaaagagaaaagatgcaaagaaatcgggtaaaaaagagcgaatagaagaaaagagagagaaaaaagaaaagcggggaaaaaataaacgagaagaagcgtatctgacaggaacatttatcagtaatcccaaagggtttggttttgttgagatagaagatgaggaaacggatatctatattccggaagaaaatacctgtggtgcattttataaagatctcgttcagatacagattgtaaaagaagaacgggaaggtcacagacgagagggaaaagttgtaaaaattctggagcatactgtgacaagtgtagttggaacagtcgaaaaaagtgacagctttggatttttaattccggacaaccgtaaaattacaaaagatatttttattccgattgaatgtatgaaaaatgcggtaactggtgacaaagcaattgcgcagataaaaaaatatggaagcagcaaacgaaatccagagggaaaaatcatcgaaattttgggacatgaaggtgaaaaaggggtagatgtcctatctgttgcaaaaagttatgaacttccgatggaatttccggaaaaagttatgaaccaggcagaaaaaattaaaacggaattaaatgaaggtgacttttttggaagaatggatttacgtgactggaccatggtgacaatcgacggagaagatgcaaaggatctggacgatgcggtatctttgacaaaagaaggagaattctatcgtcttggtgttcatattgcggatgtcagtaattatgtgcagtataatagcgcacttgaccgtgaagctttaaaaagaggaacgagtgtgtatctggtagaccgtgtaattccaatgcttccaaagaaactttccaatggaatttgttctttaaatgccggtgaagacagactggctttaagctgtctgatggatattgacaaaaagggaaatgtggtaggacataaaattgcagagacggtcattcatgtaaccgagagaatgacctatacaaatgtcaataaaattctgacgcatgcagacgaagcagtaacaaagaagtatcaggaattagttccaatgttctttttaatgaaagagttatccgaaattgttcgtaaaaaccgcaaaaaaagaggtgcaattgatttcgactttccggaaagtaaagtgattttggatgaaaatggaaaacctgtcgatatttatgagtatgaacataattcagcaacggatttgattgaggattttatgttgcttgcgaatgaaacagtggcagaggaatattattttaatgaaattccgtttgtttatcgtacgcatgaagaaccggattcagaaaaaattgagagtgtattttccatgattcgtgccggaaaaattaaagtaaagaaggcaaaagagaatgtaagcccaaaagaaattcagcaggtattaaaagaaatagaaggactcgaatgtgaaccattttttgcgagattgttactgcgttcaatgaaacaggcgaaatacacgacggactgtattgggcactttggacttgcagcaagatattactgccactttacttctccaatccgaagatatccggatttacagattcatagaattattaaagaaaatttaagaagccggatgacaaaggagaaaaaacagcattataaggaaattcttccggacgtggcaagtcgttccagtatgcttgagagaagagcagaagaagtagaacgtgaaactgtcaaaatgaagaaagcggaatatatgatggcacatattggagaagaatttgaaggaattatttccggtgtgacagaatggggcttttatgtggaactgtcaaatacgatagaaggactggtgcatgtcaatctgcttacggatgattattatgaatatgacagagaacattatactttgacaggagaggatacaggaaaggtctataaaatgggacagaaaatccgggttaaggtgttaagagcagaccttgcaacaagaacggtagattttctcccagcaaaagagaaaacagcagttttctcttatctggacgaagaataaaaagagtagaaagaaggaaagaaaaatggcaaaagaatcagggagtcgtctgattgcaaataataaaaaggcgtatcacgattattttattgaagatacctatgaagcaggaattgagcttgcaggaacagaggtaaaatccatgcgtatgggaaaatgcagtatcaaagaatcctttattcagattgaacatggtgaagtatttgtatatgggatgcatatcagcccttatgagaagggaaacatatttaataaagacccgcttcgtacaagaaagcttttgcttcatcagtatgaaataagaaaaattgcagcaaaaattgcagaaaaaggatttaccttagttccattaaaagtttattttaaaggaagtctggtaaaagtagagattggaattgcaaaaggtaaaaagttatatgataaacgtcagaccattgcaaagaatgaccagagaagagaagcggaaagagaatttaaagtaaagaatttatactaaagaatttatctaaaaagttctgagagtacatgaaatggaggacgaacatgaagttttgtgacatgccatatcagagaattgattttgctgaggcaaaaaaagaattaaatgctttgatggaagagtttaaacaggcagaagatgcagaagcacagtttgaagttcataaaaagtattataaactaaccgataaggtatcaacgcagattacgctggcatcaatccgtcataccttagatacaacagacgaattttatgaaaaagaacaggcatattatgatgaaaaagttccggagtacagcaatcttttaatcgaatatcaaaaacagctgtatcattctccttatcgtaaggaactggaaaaaaagattggtccggttgcatttaaaaatatggaactggcatttgaatcggtcaatgaaacagttattcccctgatgcaggaagaaaacgcactgacaactgaatatgagaaactgcttgcgagtgccaaaattgaatggaatggagaaattttaaatctttctctgctgggtccgtacttaaaaagcaaagacccgaaagtgcgaagagaggcatgcgaaaaacagaacgagttttacttaagtattgcagataaattggatgaaatctatgataagctggtaaaaaatcgtaccgagcaggcaaaacttcttggatttgatacctatacggagctggcttatcgacggatgcaaagaaacagttatggacaggagcaggtagaagctctgcgcagacaggtgaaagaatactgggttccattttcagaaagcctgtatgaaaaaagaaaaagacgtctgaatttggagcacttgtatttttcagatgaacaggtttatggactggaaggaaatccacagccgtcaggcagtccggaggagatactggcacagggacaaaaaatgtattgtgaactttcagaggaaacaaaagaattttttgattttatgatgaaaaatcagctgttggatgttttcggaagaaaatcgaaggcagttggtggctatatgacttatctgccagattatcatgccccgtttgtgtttgcaaactttaacggaacaagtggagatgtggatgttatcacacatgaatgtggacatgcctttcagggatatctttctgcaaaagacccaattcgggagcatgcagatatcggaatggaaaccgcagagatccattcgatgtcgatggaattttttactgagccttggtatgggctgttttttgaagggaaaactgcggatgactacaaagaaatgcacttagaagatgcagcattatttatcccttatggctgtatggtagatgaatttcagcatcgtatttatgacaatccggaattaactccagatgaacgaaaagcagtgtggaaagaattagaacagatttataagccacatcaggattatggagcgcttgcattttatgcaaaaggatgctattggcagagacagcatcatatttacagttatccattttactacatcgattatgtgattgcacagctttgcgcatttgaatataaaaataaaatggatgaagattataaagaagcatggcagagctatttaaaattatgtcgtctgtctgcatctgattattttgaaaatctgttaaaagcagcaggaatccgctctccgtttgaagaggggtgcatgaaggagattgtagataaactcaaaaagaaaattaattagaaaaaagacaaaataaagaataaaaaagaatctcgtttgagggattcttcgataaattcagaaaggagggcagggtgagctgtttcggttcaccctgcgtttatgaaaaaaactaaaaaagttaatagtaacagtcgttgttaaggtggttttgtttttctttgttgattctaatataaaccaaagatgtgaagaaactgtggttaaaatttgaaaaaactgtaaataatctaaaaaattaaaataaaaatagaaaatgaaaaaaaacttgacaaaggctgtaaaaacaggtattgtatactttgtatcaatactttcggatagaaagaccagtaacgggcttgtactggtttcgacgggggttttgaagttgaggaagccatccgcagactccgggactgcgtaccaacctggaaactaaatataaacgcagataataatttagcgttagctgcctaagtgcagcttgtcagccttaagtcacctgctgcttaagaatctggcatcgaacttgcagggcactttgctttcaaagctttgagaaagtagaagaatttatgaagctactaaatgcagcagcctgttgctcggcggttgcaggagggaatgtcaaaagaacaactgtgatgggagatgccgcaagggatagactttcggacgcgggttcgattcccgccaggtccatctgactagaagaagtcgaatttaaaaaggaatgaagaagtgtcaaagatgctttttcattccttttttgtttctcagtctatagaacaaaatggttcataagtttttaaacaagaaggaaaaaattcacaaaaatatcatagatagctgttataatgaagtaagtgttaaaagtataattgcgtttgtgcttgcacaaaaacggcaggaaagaggagtaattatggataaaggcaaaattttagtagtagatgatgaaagcagaatgagaaagctggttcgtgactttttggtaaaacagaattttgaagtattagaggctggagatggagaggaagccctggatattttttataaaacaaaagatatttctttattgatattagatgtgatgatgccaaagctggatggatggggggtctgcagagagattcgtaaagaatccaaagttccgattatcatgttgactgcaagaggggatgaaagggatgaactgcttggatttgagcttggagtagacgaatacatttcaaaaccgtttagcccgaagattctggtagcacgtgtggaggcaattttaagaagaaccaatgtcggagcgaccgatgtattggaagcaggtggaattgaagtcaataaatcggctcatattgcgacgattgatggaaaaccaatggaattgagttataaagagtttgaacttttgacttattttttggaaaatcagggaattgcactttccagagaaaaaattttaaattcggtatggaattatgattattttggagatgcaagaaccatcgatacgcatgtaaaaaaactgcgtagtaaaatgggagagaaaggagagtatattaaaacaatatggggaatgggatacaagttcgaggtttaggaattaaaaaatcaattaaagcccgtctgattgttacatttgtagggattgttgtaattgcatttgtgttgatagctctctcaaacagctttcttttagaacggtattatgtagcaaaaaagacggatgccattcaggatgtctatgaaaagttaaatcaatatgacagtctgaccggtgataaagtgcagagcttaaaaagtatctgcattgaaaaaaatatctcatgggttatcttagatacgaatcattcggaaattctggattacgacagcagaaatgcaaaccgtttatatgcgagtttatttggatacattacgggagttgcacctgcaaaaagttcgactttagaagaaaccgataattatacgctggaagtgaatcgtgacatggatatggattatcttgatatgtggggaatgcttgacaataataatgtgttcttgattcgcctgccgatggcgggaattagtgacagtatccagatttccaatatgttttatctttatacaggtatgattgttgtggcaattagtattcttgctatctggtttttaagccaacgtctgacaaaaccgcttgaagagctgacagatatttccattcggatgagtaatcttgatttcaatgtaaaatatgaaagtggtggagaagacgaaatcggtgttttgggacagaattttaataaaatgtcaaaagaactggaacagacgatttcagaactgaaaactgcaaataatgaactgcaaaaagacattgaaaaaaaagagcggattgatgatatgagaaaagaatttctttcaaatgtatcgcatgagttaaagacgccgattgctttaattcagggatatgcagaaggcttaaaagaatgtatcaatgatgaagcagaaagcagggatttttattgtgaagtcattattgatgaagctgcaaaaatgaacaatatggtaaagaaacttcttactttaaatcaattagagtttggaaacgaccagatttcaatggaatgttttgatttgaccgaattggtacgtggtgtggtaaattccgcacagcttcttgcagaccagaaagatgcacagattttgtttgttcaggatacttcggtttatgtatggggagatgaatttaaaatcgaagaagttgtgacaaattatgtctccaatgcaattaatcatatcgatggagagcggaaaattgagattaaaatgcaaaggagagaaggacatatccgactgtctgtatttaataccggaaaaccaattccggaggaagacattgataaaatctggattaagttctataaagttgataaggcgagaacaagagaatatggtggcagtggaattggcttatctattgtaaaagcgattatggaaagtatgaaccagaaatttggtgtgaaaaattatgaaaatggggtagaattctggtttgaacttgaatgcagataagcattcccccgcttcaagtgtgcggggcactaagcggcgggtgagggggatgcttctgtcagtgggagttgaaagctcccactgacagatcgcgaagcgactgcgttcatgagcaagtagcgaagcggattgcaaatgtccgctttactgcagatgagcattcatccgcttcaagtgcgcaaatgtctgctttacttgcagtcacagaatagagaaaattaaaaaaggaaatcagacaatgtaaaagtgtggttggatgagaattaagaatcgggcagaacaacaatctgtccgcttcttgctttttaatactgattctgctaaactgaatgatgccagaataaaaagagcaaacgctatttgtacttcaatatactttagatacaataagatgtttggctttggtaataaatataagaaaatatgcaaaggaggaatgactatgccgccattacaggggcagtggtatgaggctttaaagccggaatttggaaaagaatactatcgaaagttatttacaacaataggacaggaatataaaacatataaggtttttcctgcaccggatgatatttttaatgcatttcattttactccgcttgatagagtaaaagttgttattttagggcaggatccatatcataatgacggacaggcacatggattatgtttttccgtaaaaccggaggtagaagttccaccatcattggtaaatatctatcaggagctacatgatgattgtggatgttatattccgaataatggatatctggagaaatgggcgaagcagggagtgttaatgctcaataccgtgcttacggttcgtgcgcatcaggcaaattctcataagggaatcggctgggaagaatttacggatgcagcaattcgtattttaaataagatagaccgcccgatggtgtttttactttggggacgtccggcgcagatgaaaaaaagtatgttgaataatccaaaacacttgattttagaagctcctcatccaagtccattatctgcatacagaggattttttggatgtcatcatttcagtcagacaaatgaatttttaattcagcatggaattgaaccgattgactggcagatagaaaatagatagaaaacagatagaggacacaagaaagatgagtaaaaaagaaaataataataccctggtaaaaaatgcaacgtttctgatggttgctgctttgatttccaaaattataggtatgctttataagagtccgctgactacgttaattggacgagaaagttttgcctgttttcagtttgcacagaatgcgtattttattttgttgatgattgcttcctttagtattccgcaggcagtatcgaaaatcatgtcagagagaattgcatttaaacgttacagggatgctcagagagtttttaaaggagcactcttatatgctgtaatagcaggtggaattgcggcacttgtttgtattttcggtgcgtctattttagtaccggataatatggcaaatgcgagactggcgcttcagatgttagcaccaacgatttttgtatctggtatcttaggtgtgtttcgtggatatttccaggcatatcgaaatatgcttccaacttcgatttcacagattttagagcagattgcagtggcgacagtagctcttttagcttctggatttatggtgcgccactttgctaatgcaggagaagatactctgcaaagatggagtgcagcaggtgctacaatgggaacaggagccggcgtctgcaccgcctttttatttatgctttttgtctatagagtgaatcataagacgattgcaaagaaaataaaaaatgacagagtatcggtaaatgaaagctatcgcttcattatgaaaataattttgctgattgcagctccgattatcttaagcgcatttatttataacgtaaacggttatattaatggagtgatgtatacttcgattcttggctggaaaggtgttccaaacagtctggtaaaacagaattatgcagagtatggcttctttatgacattgattaatattccgctgactcttgcaagtaccgcaccgacttccatgatgcctgaagtatctgcacagtatgcgattggtgatttagaagaaacaaaaagaaagattgaccaggcaacatggattgcgatgctgatttcgattccggcgtctgtgggacttgccgtgcttgcacagccggttacacgcctgattttcccatccacagagggagttgcaggacagctgatggtgattggcgttattacggttatcttaaacagtacttcaaatatttcaaatggtgtgcttcaggcaatcggaaaagccaatattcctatgattaatgcagcaatttcgctgggagtcgatattgttttccttgctctggtgttagtatttaccaatatgggaatctatgcagtcgtacttgcgatggtggtatatgcactggttatgtgtgtcttaaatgatcgtgcattaaagaaatacttaggatataaaaatccgtggagatctgcctattttgttccaatcttagcatcgattccaatggggattgttgcagttgctgtatataaactggtgtatgcagtgatcggttcgaattttatttccctgattccatcgattgtacttgcaattgttgtttattttgtgggatatttagtggttgcaaaaccgaaaaaagaagatttggcagcacttccgggaggaacaagactggcacaggttgcacagaaattaaagattttaaaataaaccaaaaagaccatttcatccattcaattttggatgagatggtcttttttagttcagctaagaattagttgtttgtttcatcaagtcgtttaaatgcagtagaaagcattaatttaattcgatttaattggtttacttcacttgcacctgggtcatagtcgattgccacgatgtttgcctttggatattcttttcggatggctttaataacaccttttcctacgatatggtttggcaggcaggcaaatggctggatgcagacaatatttggagcatcggagtgaatcagctccatcatttctccggttaagaaccagccttcaccggtttgatttcccatagaaacaattggtgcagccatttttgccaaatcttcgattttggcagatggtgtaaagtgacggctcttttcaaattctttattggcagtaccgcggataaattcaagggctttgattccaaggtttgctgcatttgcagtagattttttgaatccaagtttttctgctttaaaattctggttatagaagcagtagttcatgaagtccagtaaatccgggcatacggcctctgcaccttctttttcaagcagctctgccagatagttgtttgcagccggaaggaatttgacaaggatttctccgacgatgccaacacgtggtttcttttcgtttgtgattggcagggtgtcaaattctcgtatcatctggcggcagatacggttaaattgtgcgaaacctgcatgttttccggaaacaaattccatacaacggcgttcccatttgcggtgcagggcatttgcagagccttttacggattcataaggacgcatccggtaaagacatttcataaggacatcaccaaatactgcaccgtaagcgagacgggttgcaagttttggtgtaatcttaaatccgggattggcttcgagtccgcttaagttaatagagataaccggaataaatcctaaatctgctttctttaaagcacggcggataaatccaatatagttggaagcacgacatccgccaccggtctgtgacatgataattgccactttatgtacatcatattttccggaaagcagagcctgcataatctgaccgactaccattaaggatggatagcaggcatcgttatttacatattttaagccaacatcaacggcttctttgttatcatttggaagtacctctaaatgatagccacaggagttaaaagcagattccagaatagaaaaatgaatcggtgacatctgaggacacagaatcgtataatcttttctcatttcctgagtaaacggaactttcttgatggaggatggtacaattttgcgggtagcgttttgtttttctttaatgcgcagggctgcgattaaggaacgaatacggattctggcagcacctaagttattgacctcatcaatttttaagcaggtataagtttttccactgtttgaaagaatttcattgacttcatcggttgtaactgcgtcgagtccacatccaaaagagttcagctgaattaaatccagattgtctttttcttttacaaagtttgcagcagcataaagacgggtgtgatacatccactggtcattgacacgaagcggacgttcaatcggtgctaaatgagaaatcgaatcttctgtcaaaactgcaattccgtaagtgttaatcaaatccggaataccatgatggatttcagggtcaatatggtacggacgtccggcgagtacaattccacgacgaccggttttttccagataatctaaagtttcttccccttttctgcggatgtcttcccgacagtgtgccatttcaacccatgcaaggtgagctgcattttgcacttctgaagccggaatatccgaaaattcttcgataaggcgtttcgttacggtttcctcgttggttagggcaagaaatggattatgaaaacgaatatttggattgtccagttcatcaatattatttttaatattttcggcgtaagaagtgacaattggacagttataatgattaatggaatcttcaaattccgtacgttcataaggaacgcaaggatagaagatgtaattgacgttttgtttaatcagccaggaaacatgtccatgtgccagctttgcaggataacattccgattcacttgggatggattcaattccaagctcgtaaatctttctggtagaggttggagaaaggacaacctgatactttaattgtgtaaagaaggtataccagaatggatagttttcaaacatatttaaaacacgaggaattccgacttttcctctgactgccttatcttcggtaagcggttcataagaaaagagctttttgtatttgtattcataaagatttgggattctttctttatttttctcttttccaatcccacgttcacaacggtttcctgagataaactgacgacctcctgagaatttattgatagtcagacggcagttattggtacagcctttacagtttgccattgtggttgtgtattttaattcattgattttatcaatggataacatggtcgtttcagtaccggcactataacgttctcttgcaatcaaggcagcaccgaacgctcccatgataccggcaatgtccggacggatagcttcacagttggcaattttttcaaaacttctaaggactgcgtcattataaaaagtaccaccctgtacgacgatgtggcgtccaagttcagaagcatcggaaactttgattactttgtacagggcatttttgataacggaataggcaagaccggcagagatatcggaaacttctgcaccttctttttgagcctgttttacttttgagttcataaatacggtacatcttgtaccgaggtcaatcgggtttttcgcaaataatgcagctttggcgaaatcctgtacactgtaatttaaggaatttgcaaaagtttcgatgaaagaaccacagccggaggagcaggcttcattaagctgtacactgtcaacggtctgattcttgattttgatacatttcatatcctgaccgccgatgtctaagatacagtctacttccgggtcaaagaaggcagctgcatagtaatgagaaacggtttccacttcaccttcatctaacattaaggcagctttgattaaagcttcgccatatccggtagaacaggaataagcaatttttgcaccctgtggcagttctttataaatctgctgaatggcacggatacttgtagcaagcggatttccgttgttattgctgtaaaaagagaacagtaaagaaccgtcttcaccgacaagggctgctttggttgtagtagaaccggcatcaattccaaggaaacagttccctttataagaggctaagtctcctgtttttacggtatactgactctgacgcgtgttaaatgcatcatagtcttcttttgaagcaaaaagcggttccatacgattgacttcaaattccattttaatgttggcagaaagacggtctctcatctcggtaatagaaacatcggatgcatcttctttggcgtttaaagcagaaccgatagctgcaaataagtgagaattttccggaacaatggtatgttcttcatcaagttttaaggtacggataaaggcttcttttaattcagaaagaaagtgaagcggacctccaaggaaggcaacatgtccacgaattggttttccacaggcaagaccactgatggtctgattgacaactgcctgaaagatagaagcggacaggtcttcttttgtggctccttcattgattaacggctgaatatcagtcttggcaaatacaccgcaacgggctgcaatcggataaagtgctttgtaatgttttgcatattcatttaagccaggagcatccgtttgaagaagagatgccatctggtcgatgaaagaaccggtaccaccggcacagattccgttcatacgctgttctacatttccgccttcaaaataaataatttttgcatcttccccaccaagttcgattgcaacgtcggtaagcggagcacgttcctgaagggaagtagaaactgcgataacttcctgtacaaatggaacttctaagtgattggcaagggtaagtcctccggaaccggtaataaccggatggacagaaattgcacccagtttctgataggctttatctaaaagagaggccagtgtattttgaatatctgcaaaatgacgttcataatcagagaagagcagttcatttttctgacccaaaatggcaatttttacagttgtagaaccgatgtcgattccaagtggatagacgaacggtttggtatcttgtaatgttggcataaagaaacctccttaatttgagtaaataccaatgtaaaaaaatgggacggcaaaaagccgccgttaatgagttatttcctatttattataaaaaaagaaaaaaatatcgtaacaaatccaaaaaaattcagacaggttacaaatcaaagtacattatacgacaagatagataaaaaaacaattggaaatttgtctgacttatgatagaatatttccgtatctattgttgtatttagagacaggtttgaagaaaataatagagtacaagaccaaaaatacaggaaatttttcaattagagagaggaagtttttatgtataaaattttaaaaaaagatgggatggcaaaacgtgctcacatggaaacggtgcatggaagcattgaaacaccggtgtttatgaatgtaggtacggtagctgcaattaaaggtgcagtttcaacaaccgatttgcatgaaataaaaacacaggtggagttgtcgaatacgtatcatcttcatgtccgtccgggagatcaggttattaaaaaattaggcggacttcataagtttatgaactgggatcgtccgattcttacagattcaggtggatttcaggtgttttcgctggcaaaattaagaaaaattaaagaagaaggcgtttattttaattctcatgttgatggaagaaaaatctttatgggaccggaagagagtatgcagattcagtcgaatttaggctctacgattgcaatggcatttgatgaatgtccgtcaagtgtggcagacagagagtatgttcaaaattccgtagaacgtacaacaagatggcttgcaagatgtaaagctgagatgaaccgcttaaattctttagaagatacggtgaatccgcatcagttgttgtttggtatcaatcagggagcaatctatgatgatatccgtatcgcacacgcaaaagaaatttctaaaatggatttggacggttatgcagttggtggtcttgcggtaggagaaagccatgaagagatgtaccgaattttagatagtgtagtaccatatcttccggagaataaaccaacttatctgatgggagtaggaaccccggcaaatattttagaggcagtttcaagaggtgtggatttctttgactgtgtttatccaagcagaaacggacgacacggacacgtgtataccaactttgggaaactgaatttattcaatgcaaaatatgaactggacagccgtccgattgaagaaggatgccagtgtccgacctgcagaagctacagcagagcctatatccgtcatcttttaaaagcaaaagaaatgcttggaatgagactttgtgtgcttcacaatctgtacttctataatacaatgatggaagaaattcgcggagcaatcgaagaaggacgttacgaagaatataaacaggaaaaattagagcgtatggcagcaggaccaaaagattgatttttggtagagaagcttgaaaccagtctttgatagaaaaacgaaaaataaaaaatctatgaaaaagaacaaaaaggcttgaagtcacgcataaaattgtgtattatggtaataacgttcaaataggcaggaggaactaaaatgtttttagcacaggcaagtgcaagtggaacaggagcaatcgcatccatgttaataccgcttgttatattttttgttttgatgtatttcatgattatgagacctcagaagaaagaacagcagagagtcagttctatgttatcttctatggaagtaggagacagcgtggtaacaaccagcggtttttacggaactctgattgatattacagaggaagatgtaatcgtagaattcggaaacaacaaaaactgcagaattccgatgagaaaagcggcaatcgcggaagtagaaaaagcaagcgatggaatcgtagaaaaataaaacggaaaaacaaaaatagaaacaaaaaaacagaaacagatgttacgggcttttagcaggtggcatctgtttttttaaattcataggaaatttcgtcctgtgaattcaaaaaaacattaaaaattcattctgccttaaaaaggagaagaggttatggcatttatcagtttatttgaagtaatcggaccaaacatggtaggtccgtcgagttcacatacagcgggggcggtttctatggcactgcttgcaaggaaattatttccggcggaaatcaaaaaagttgagtttacgttgtatggttcttttgcaaaaacatatcggggacatggaacagaccgtgcactgcttgggggaattatgggatttgagacagatgatttgagaattcgggattctctttcaatcgcaaaagaacgaaatctggactatcatttttcaattggacaggatacaggagaagaacacccaaatacagcggatattgatatgacaggggtaaatggagaacggctttttgtaagaggcgtatccattggagggggaaaagtaaaaattgtacgtttaaatcagattgatgtggattttacaggagaatacagtaccttaattatcagtcagacagaccgtccgggagttgtagcgcatattacaaaagtgcttagcgaaagagaagtaaatattgcatttatgcgtctgtttcgggaagaaaaaggtgcaaaagcatttacagttgtagagtcagatgagagaattccggatgaggttgtggaacagatacgggaaaatcctctggtttcggatgttatgctggtacagatttaagaagaggcaggagagaatgatggattttaattatgcaggtgagttgttaaagttatgtgaggaaacgaaacttccgatatctgaggtgatgaaacggcgtgaaatggatttttcttctatgacagcacaagaggtcgaagaaaagatgagaaagtcgctggaaattatgaagacggcggcaaaagagcctttggaaaatgaaaaaccgtcgatgggaggactcatcggaggagaagcgaaattattattttcacaaaaaggaaaagagaaagatatctgtggagatgtcgtgttaaaagcaattacttatgcgatggcagttttagaagtaaatgcctcaatgggtgtgattgttgcagcaccgacggcaggttcagcaggagtcattccaggggtatttcttgccttaaaagaagaaaaagcattgtcagatgaaatcttattaaaaggtctgtatactgcaggtgcagtgggatatctgcttatgagaaatgcatccgtagcaggtgcggaggcaggctgtcaggcagaagtcggtgctgcaagtgcaatggcggcagcaggtgtagtagaaatgtttggcggaacaccaaagcagtgtctggacgcaggctctctggcactttctaatctgttaggtctggtctgtgacccgattgcaggacttgtggaagcaccctgccagaaccgaaacagcattggagcgacgaatgcattaatctgtgcacagcaggcattagcaggaataaaagccctgattccatttgatgaaatggtagaagcgatgtatcatgtaggaagaagtctgccatttgaactgcgggaaagtgcacttggtgggtgtgcgggaacaaagacgggatgtcagaaaacctgtgaaattttccggaaaaatgaataaaaatgcataaaaaaaagaagtgttatagcttatataacgaaaaagaatagccaaacactttattatgccttgaaataaagcccaaaaaggattatcatatttagataaaaagtgacaaaatttctggaagggagagagaactcatgaattataatattgcacttatttcaggagatggcattggtcctgagatcgtagcagaagcaaaaaaagtactcgataaagtgtgtgaagtgtacggacatactttttcatataaagaggttttattaggaggagcatccattgatgttcatggtgtaccgcttacagaagaagcaattgccgatgcaaaggcttcagatgcagttttgatgggttctatcggaggagatgcaaaaacttccccatggtacaaattagagccatccaaacgtccggaggcaggtcttttagcaatcagaaaagccctgaatttatttgcaaacttaagaccggcttatctgtacaatgaattgaagggagcctgcccgttaaaagaagaagtaatcggtgatggatttgatatgattatcgttcgtgagctgacaggcggtctgtattttggagacagaaagacttatgaagaaaatggtgtacagacagcagtggataccctttcttataatgaaaatgaaatccgcagaattgcagtcaaggcatttgatattgcaatgaagagaaagaaaaaagtgacaagtgtggataaagcaaatgtgctggattcttccagactttggagaaaagtagtagaagaagtggcaaaagattatccggaagtcacattggagcacatgctggttgataactgtgcaatgcagttagtacataatccagctcagtttgatgtgattttgacagaaaacatgtttggagatatcttatccgatgaagcaagtatggtaacaggttctatcggtatgctttcttctgcaagtttaaatgaaaccaaattcggtttatatgaaccaagccacggttctgcaccggatattgcaggaaaaggaattgcaaatccgctggctaccattttatccgcagcaatgatgcttcgtttctctctggacttagacaaagaagccgatgcaattgaatccgctgttcagagcgttttaacagaaggataccgtactgtagatatcatgcaggatggaatgaaacaggtagggacggcagagatgggcgatttaattgcaggacatatcgcataaaagtatcgtatcaagaaaggatgttaagaaaatgaaaagtgatgcagtaagaacaggcatgcagcaggcacctcatcgttccctgtttaatgctcttggaatgacaaaagaagagatgtcaaaaccgttagtaggtattgtaagctcttataatgaaattgtaccgggtcatatgaatctggataaaattgtaaatgcagtaaaacttggagttgccatggcaggcggtactccggttgtatttccggcaattgcagtctgtgatggaattgcaatgggacatatcggtatgaaatactctcttgtaacaagagatttgattgcagattctacagaagcgatggctctggctcatcagtttgatgcccttgttatggtgccaaactgtgataaaaacgtaccgggtcttttaatggcagcagcaagaatcaatgtaccgactgtttttgtaagtggcggtccaatgttagctggtcatgtaaaaggacaaaaaagaagtctttcttccatgttcgaggcagttggttcttacagcgcaggtacaatgactgcagaagatgtagaagaatttgaaaataaagtatgcccgacctgtggttcctgttctggcatgtatactgcaaacagtatgaactgcctgacagaagtattgggtatgggattaaaaggaaacggaacgattccggctgtttattctgaaagaattaaacttgcaaaacatgcaggtatgcaggtaatggaaatgtaccgcagaaatatccgcccacgtgatattatgacaaaagatgcaatcatgaatgcgttaacagttgatatggcgcttggatgttctacgaacagtatgttgcatcttccggcaattgcacacgaaatcggatttgattttgatattacatttgcaaatggtgtcagtgcaaaaacaccaaacctctgtcatttggcaccggcaggttctacttatatggaagacttaaacgaagcaggcggtgtttacgctgttatgaacgagctggctaagaaagatttattaaatctggattgtatgacagtaaccggaaagacagtaggagaaaatatcaaaaactgtgttaacttaaatccggaagtcatccgtccaatcgacaatccatacagccagacaggtggacttgctgttctgacaggaaaccttgctccggatggtggtgtggtaaaacgttctgcagtttgtgaagaaatgatggttcatgaaggaccggcaagagtatttgactgtgaagaagatgctatcgcagcaattaaaggcggaaagattgtagcaggagatgttgtagttatccgttatgaaggaccaaaaggcggtccgggtatgagagaaatgttaaatccaacttctgcaattgcaggtatgggtcttggttcaagcgttgctttaattacagatggacgtttctcaggtgcctcaaggggtgcatccattgggcatatttctccggaagcagcagtaggcggaccaattgcactggtagaagaaggtgatttaatccgtatcaatattccggaaacaaaactggaattagtggtatcagatgaagagctggagagaagaagagcaaactggcagccgagagagccaaaagtaacaactggatatctggctcgttatgcttctatggttacaagcggaaaccgtggtgcagttttggaaataaagaaataaaaaaacgttgggagggcttcgagatgcagttgacaggatcagagattgtaatcgaatgtttaaaagagcagggtgtggataccgtatttggatatccaggcggaaccattttaaatatttatgatgaattgtataaacacagtgatgaaatccatcatattttaacatcccatgagcagggtgctgcgcatgcagcggatggatatgcacgttcaaccggaaaagtaggcgtctgttttgcaaccagtggaccaggagcaaccaatctggtaacaggtattgcaaccgcatttatggattctgttccggttgttgcagtaacttgtaatgtaggtgttccgcttcttggaaaagacagtttccaggaagtagatattgcaggtgtggtaatgccgattacaaaacacagctttatcgtaaaagatgttacaaaacttgcaaaaacactcagacgtgcgtttgcgattgcaaaaagtggcagaccaggaccggtcctagtcgatattacaaaagatgtaacagctgcaaagactgaatacacaaaggttgagccaaaagaaatcaaaccgtttgtctctgaaattaaagaagaagatttagaaaaagcggttgagatgattcaggaagcaaaacgtccgtttatctttgtaggtggaggggcggttgctgccgatgcatggaaagaagttcgtgaactggcacataagattcaggcaccggttacagattctttaatgggaaaaggtgtttttgacggcgaagatgaactttatactggtatgctgggtatgcatggaacaaaggcatccaatcttggtgtgaccaaatgtgatttgttgattacgattggtgcaagattcagcgaccgtgtaaccggaaatacaagaaactttgcaagaaacgcaaaggtacttcagattgatgtagatgcaaccgaaatcaataaaaatattttagtagactgtagtgttttaggagacgcaaaagtaattcttcagaaattaaatgaaaaaatatctgaaaaagagcataaagaatggatagaaaccatagaagaattaaaagaaaaatatccgcttcgctataatcaggaaggtctgaccggcccggcagtcattgaagaattatatcgtcagacgaagggagacgctattattgtaacagaagttggtcagcatcagatgtgggctgcacagtattataaatataaaatgccgagaagatttttatcttccggtggacttggaacaatgggatatggacttggagcagcaatcggtgcaaaaactgcaaatccggataaagttgtcatcaatgtagccggagacggatgtttccgaatgaatatgaatgaaattgcaactgcgacaagaaacaatatgccgttaattcaggttgtcatcaataaccatgtattaggaatggtacgtcagtggcagactttattctatgatcacagatactcaaatacagtattaaatgacaaagtagattttgtaaaactggcagaagcgatgggagcggtaggaatccgtgtcacaaaaaaagaagaacttgccgatgcaattaaaaaggcaattgaattaaatacaacagttgtattagactgcattattgattctgatgataaagtattcccaatggtaccggccggtgcaaatattgaggatgcatttgatgaggatgatttaagagcaaagaaaaaataaaaaatagctgttttagtcgaaaaagagtttggctggacagatggatgtctttgtaataaagacaaatgtttatattgacaaaaatatgtcaaagatgtagaatactctttatacaaataaagagtattctattattctatacgggaggaacaaagaagtgagcagagtgtataatttttcggcaggaccagcagttttaccggaagaagtgttaaaagaagcagcagaagaaatgttagactacaatggaagcggtatgtccgtaatggagatgagtcaccgttcaaaagtatttgatgaaattattcagactgcagaagcggatttaagagacctcttaaagattccggataattataaagtactgtttttacagggcggtgcaagtcagcagtttgctatgattccaatgaatctgatgaaaaacagagttgcagactatattgtgaccggacagtgggcaaaaaaagcatggcaggaagcccagaaatatggaacagcaaataagattgcatcttcagaggataaaacattttcttacataccagactgttcagaccttccgataagtccggatgcagactatgtatatatctgcgaaaataacacaatttatggaacaaaatataaaacattaccaaatacaaaaggaaaaatccttgtatcagatgtgtcctcctgtttcctttctgagcctatggatatagaaaaatatggtattgtttatggtggtgttcagaaaaacgtcggaccggcaggtcttgtgattgcaattatccgtgaggatttgattacagaagatgtacttccgggaactccaaccatgttgacttataagacacatgcagatgcaaattccttatacaatacaccaaactgctatggtatttacatttgcggaaaagtatttaaatggctgaaaaaacagggcggtcttgaagcaatgaaagaacgtaatgaaaagaaagcaaaagtgttatatgattatctggacagcagtaaattatttaaaggaacagttgagccggcttcccgttctttaatgaatgtaccgtttgtaacaggagataaagaacttgatgcaaaatttgtaaaagaagcagaagcagcaggacttgtaaatttaaaaggtcatcgtacggttggcggtatgcgtgcaagtatttataatgcaatgccaattgagggtgtggaagcactggttgaatttatgaaaaaatttgagaaggagaacgcatagacatgtataaatatcattgcttgaatccaatttcaaacgtaggactggaatattttccgggaaaatatgaaaacagtgaatctcttgaagacagcgatgtggtactggtaagaagtgcaaatatgcatgagatgcagcttccgaaaaatgttgttgcagttgcaagagccggtgccggagttaacaatattccgttagaagactatgcaaaagaaggtgttgtcgtatttaatactcctggtgcgaatgcaaatggtgtaaaagagatggtaattgcaggtatgttacttgcatccagagatatcgtaggtggaattgaatggttggaaaaacaggaagcaaccgacgatatcgcaaaacttgcagaaaagaaaaagaaacagtttgcaggctgtgaaatcagtggaaagaaacttggaattatcggtcttggagcaatcggtgttaaagttgcaaatgctgcggtgcatctcggaatggatgtttacggatatgacccatttatttctgttgatgcggcatggaatctttcaagaagtattcatcacatcaatgatttaaatgtgatttataaagaatgtgattatattaccattcatgtaccgcttctggattcaactaagaagatgattggtgcagatgaaatcgcacagatgaaagacggtgtggtattgttaaactttgcaagagacttgctggtagatgaagaagcacttgccgaagcattaaaagcaggaaaagtaaagaaatatgtaaccgactttgcaaatccattagtggcaagtacaccaaatactttagtaacaccgcatcttggagcttctacagaagaatccgaggataactgtgcagtgatggctgtcaaagaattaatggactttgtagaaaatggaaatattaaacattctgtaaactatccggattgcagtgcaggaacttgtgtggatgttggaagagtgacgattaatcataaaaacattccaaatatgattagtcagtttacaaaagcattaggtgatgcaggagtcaatatttcaaatatgacaaataagagtaaaggtgattttgcctataccatgattgatgtatccactccgatttcttcagaagtgacaaaggcattaaaaaatattcagggtgtttatcgtgtcagagtgattaaataaaagataattaagaaaggcagggctggcagtttttttctgcatggctctgtcttttttactttatccaaatttaaggagagaagaaaaatgtcagatatcagaccgttttgtgcagtgcgtccaaacgaaatatttgcatctaaaattgcagcactgccttatgatgtatacacaagaaaagaagcgaaaaaagaagtagaaaaaaatccattgtcttttttaaagattgaccgtccggaaacgatgtttcctgatgagatggatatgtatgcaccaaaagtctatcgaaaggctcgtaaggtgttggaagagatgatagaaaaaggagaattcattcaagatgaaacaccttgttattatctctatgagctgaccagaaatggtcacagacagaccggaatcgtagcctgtgcttcaattgatgactatttcaatggaacaataagaaaacatgaaaatacaagagaagaaaaagaacaggatcgaatccgccatgtggatacactggacacccagacaggaccaatttttcttgcctatcgtttggatgctgttttaaaagaaattatcgaggaaacaaagagaaaagcaccggtttatgatttcatttcagaagacaaaattacacacagggtatgggtgattgatgaatcagaaatgatggaaagaatacaacaatgttttgtaaagataaacaaaatttatattgcagatggacatcacagggcggcttctgcaatcaaagttgggtgtaaaagaagaaaagaacatccaggttatacaggagaggaagaatttaattattttttatgtactttatttgcagaggaagaactggaaatcttagattataaccgtgtggtaaaggatttaaatggtcttagcgaaatagaatttttagaaaaaatcaaagaaagttttgaagtggaagaagcagaggaaagtccttatgcgccaaaacagaaaaaagaatttgggatgtatcttggaaagaaatggtataagcttcagattaaaaaagagcaggtttcagatgatgtagtcgaaagcctggatgtgtctattttacaaaataaattgttaaaaccgattcttggaatcaaggaaccaggaaaagacaacagaattatctttgttggaggaatccgcggattaaaagagttggagcattgtgtggaaaatggttttcaggtggcattttcaatgtatccgacttctatgcaggaacttttttctgttgccgatgcaggcagattgatgccaccaaagtcaacctggtttgagccaaaattaagaagtggtttattccttcataaaattgggtaacggttagtcagaattgaaaaaatattccgctgtaagtttgtttttgtaatttgtagtgttagtttacaatttcacactttaatgttaaaataaacaaaaaggagagtgtgttatgtctgataaattatatgaatacatggattggcctgagatagaggcagttgtttattctgaggagagcgagccacgtaagattttaggacctcgcgtgacagaagatggaattttaatacagagttttttgccaaatgcggtaaaagcaaatattattgtaacaaaaacaaaagaaacgtatgaaatggttagggaagatgaagctggttattttgcaattttaattccggaaaaagagattccaaaatataaaatcgaaatagaagatgaagagggaaaaaagagcagtttttatgacccttatgcatttccaaaacagatttcagtcaatgaagaacagcagttttgtgccggaatcagttatgaaatttataacaaattaggggcacatgtaatgacaataaatggaatcaaaggtgtttactttgcagtatgggcgccaaatgccatgcgtgtgtctgtcgtgggagatttcaaccactgggatgggagagctcatcagatgaaccgtctttcagtgtccggcatttttgaattatttattccgggagtaaagccaggtgcattatataaatacgaagtaaaggccaaaggttctctggtttatttaaaagcggatccttatgcaaacgaagcagaattaagaccgaaaaatgcatccatagtggcagatttaaagagctataaatgggaagatgaaagctggatgaagaatcgaaaagacgtcaataatgaagaaaaaccgattctcgtctatgaaatgcatttaggctcttggagaaaaccggaggatcggctgttttatacttaccgtgaacttgcaccacaggttgccgagtatgtaaaagagatgggatatactcacgtggaactgatgccggtgatggaacatccgtttgatggttcctggggttatcaggtgaccggatattatgcaccgaccagccgttatggaacaagtgaagattttatgtattttgtggattatcttcataaacagggaattggtgtgattttagactgggtgccggcacattttccaaaagataattttggactgtctaattttgatggaacttgtctgtatgagcatgcggatccgagacagggcgtgcatccacactggggaactttgatttttaattatggacgtcctcaggtttccaattttctgattgcaaatgcaatgttctgggcggataaatatcatgtagatggaattcgtatggatgcagttgcttctatgttatatctggattacggaaaaaatgacggagaatggattccaaatatttacggtggaaatgaaaatttggaagcaattgaatttttaaaacatttaaattccatgtttaagaaaaaatatccggatgcattgttaatcgcagaagaatccacagcatggccgaaaattacaggtgaactcaatgatgaaggacttggatttgactataaatggaatatgggctggatgaatgattttatcgattatatgaaaaaagacccgctgtttcgaggtggtgcacatgatgaattgacattcagtatggtatatgcttatagcgaaaaatttatgctgtgtttgtctcatgacgaggttgtacatggaaaggcttctcttttgatgaaaatgccaggaacaatggaggaaaaatttgcaaatttaagagctgcgtatggattcatgaccgtacatcctggaaagaaattactgtttatgggacaggaatttgcacaagaaagagaatggtcggaagaaagaggtcttgactgggaactgttagagacaccggaacatgcacagtttcaggaatatgtaaaggcattgtggaaattttacagagaggctcctgcactttatgagctggatgatgatccggatggttttgaatggattaatcatatggaatctgaaaaaaatatgctgactttaatccgaaaatcaaagaaaaaagaagagactttggtaattgtctgtaacttctcagcactgaaatatgaaaaatatcaaatgggtgttccttatgccggcaaatacaaagaagtatttaacagtgatggaaaacaatttggtggtacaggagcaggaaatccaagattaaaatcatcgaaaaaaacagaagcggatgagcgtaaaaattcgcttacaattacggttgcaccacttgcaattcagatttttgcgtttaaggaagcggaaggagagaaaaaagcaccgaagaaaacagttcggaaagcacttgaaaagaaaatagaaaaagaacgggaaaaagaattaaaacagcaggaaattaaacttccaaaagaagaagtaaaatcaatgccggaaaaatcgaaagtaaagccggaaccgaaaaagcttgaggcaaaaccagagccacaaaaactggaagcaaaaccggaaccggaaaaacttgaggcaaaaccagagccacaaaaactggaagcaaaaccgaaaccgaaaaaactggagagaaaaccaaaaaagaggggaagaacaggaaggaaaaaataaggaaataacgtatgaaattggatttatatttagcccagacaacagagttgcaaaaaatagcgagccgtctgttagagggacttcctaccattgaaaaatgggtctttcgggttttactttccgtgattgcatattttgtggtcggaaagttaattaagaaagtctgtaatttcctgaagacggcattacaaacagcaggagtggaagttggggcaacccagtttatctcttcatttgcaaaagctgcaatgtatgtggtacttttgatgataattggagtacagcttggaattaaggaatcatcgcttgttgcagtattggcatctgccggtgcagctctggtactggcactgcagggaggtctttccaaccttgcaggaggggtaatcattcttgtacttcagccgtttaccgttggagattatattattgaaagtacaaataaacaagaaggaacggttgtgaaaatcgatttgttttatactactttgaccagtgtggataataaaagaattattgttccaaatggtactctgacaggtgcaagcattgtaaatgtaactgcacaggacagacgaaatcttgagattaagattatgatttcctatcaggcggatttaattaaggcgaaatctattttagataggcttttaagagaagatccgactacgatgtcagataaagaaatgaaagtatttgtcgatgaactggcggatgacggtgtgattatcggatttcgtgtatgggtaaaaacagaagattactggccgacaaaatggcgtttaaatgaggcaatcaaacttgcatttgatgaagaaaaaatagaaattccatacccacagttagatgtgcatattaagtaacaggacacaaatctgtatctattttgctatgcagtgttgatagaaaatgaatacgctgtcatgaaaagtctgctgaacataagcgaacaaaacgtgcagaaaggagcagtcttatgaggaaatttagattactgccggtaattgcggtaagtacagtcttgatgatgggaatcacaggctgtgaaagtaccacacaacaaccagcaaaagaagagacaaaaaaagaagaaacgaaagaggaagagacgaaacagcctgaaacatccaaagaaacggattcagaatcaacagaaacaaaagatacaacagaagaaaaagacggaaaagattctgaagcagagaaaaaagaagatattacaaaagaaacagaatcagaaaaatcgcaggaagaacagttgaccttatatttgccaaatgaaaatgcggatggctggaatgttacaaaaaaccagatagagcaggttacaccagatatcatcattggacagcttgtaggggcaggtgcaattccggacagcgtgacagtagtaagttttggagaagatcagggagaaaatggtttgattttgaaactggatttatcttctaattttgtagaaggacttctcaatatgggaacggccggcgaatatcttacaatgggagctgtggtaaatagttttcttgatacttatcaggcagatggaattgagataacagctggtggaaatgtgattgaaacaggtcatacgtcatttgaaggtgtgttaaatcatttcgattcgaatgaaagtcaataatgcataagttaagatagagtgagaactgttttgaaatttaaaatgatttttggggacatggtattttggatgccatgtcccctttgtttatagacaatttataatttttaattgacaatacatattattttggaaattttcgtggtatcattaaacacaagaagagatgaagaggatatggagttgatcagagaatgaaaacacaggtgttgtatatgagcagaactggaaataccgaaaagattgcacaggcgattttttcagcaattccaggaaaaaacaaagatattgcaaggtttgcaggacaaaccgattatgatatgggagatatttattttattggattttggacagacagaggaagtgcaagtgtagaagttttggattaccttggttctttacagggaaaaaaaattgccctttttggaacttgtggaatgggagaaagcattgaatattatagaaaaatagaagaacgtatcaaagtatttattgaagatggaaatcagtatctggggtgttttttatgtcagggaaagatgccgatgcaggtgcgggagaaatacctgaaaatgaggcatcctggaaatgagggacaaattcagaaaatgctgcagaattttgataaggcactgcttcatcccgactggaaggatatggaaaatgcccagagatttgtgcatagaatatacagtagattatagaacaggatgtgagaagaaatgaaagaaaaaattggaagatttatggcgggaagatatggaaatgacaaattaaatcagtttatgatggcagtatttttaggatgcgcagtattaaatctgtttgttcggaatgcttatgtttcgacggttttaaattcatgggaatgtttattgattttgctggtttatattcggatgttttccagaaatatttcaaaacgttatgcagaaaatcagaaatatctggcattggaaaaccgtctgcgtcgtttttttggacagaaaagatatctgatgcagcagagaaaggaatatcatatttataaatgtccaggctgtaaacagaaaatcagaatcccgaggggaaaaggtaaaatcagtatccgatgtccgaaatgtggagaagaatttatcaaaaatagttaaaaaataacttgattttttgtagaaaatctagtacaatcatctttgcagtgataagctgaaatagctcagttggtagagcacttcactcgtaatgaaggggtcgtgggttcgagtcccattttcagcttttccaaattcaagctatctgtcaaactggcaggtagcttttttaatttatcccttgttcttttcctgaataaaacttaagggaactggaaagagtatttgtatgttctcgggtaaaggagaagaagattgaaaatgagaattataatagttgcagtgataatctgtttcagtatatctgggtgtgaagcgaaagacacagcgcaggacagagaactggtaaaaatcagaacaatagagaaaggggacgaaatacaggatggaaaactatgctttttctccctggaaagaggggagaacacaggaagagaaacaatatctgctacaggcagaggaactagagattgaagatggagtcgaagcgattggaaattatacattttatggatgtagaaatctaaaaagcttaaagtttaccgattctttgaaacagattggtggtggttcatttacggggtgttcagcacttagaaaactttatgtaaaaatgaataaaaacatgccaagctgtatcaaagatgttgttgcagaaacctttcatgaagtctatgtgacaattgaatttcgggaaacaggagagtttgcaaaattaatctttccggagtattatgaagaaggtgtggaaaatacaccggcgagaattttagagacacactttcatggctgcgggtatcgttatcgccagtgctttacagataagaaagtagactatcatcaatatgattccctttttaaagtagcgaaggtctatgaaaaacaggatattttaattccgatggcgctgggaaggctgatgcatccttatgagctggcggaagaacacgaagcagattatcggcagtacataacagaaaagctggaagagaccggaatctattatttaaaacgggaaaactggcatgagggactggcttatctgataagaaagggagtctcaaaaagcgaagaagcggagcagttgattacccttgcatcaaaagccgagcatacagaagcggtcagctttttgatggaagaaaaaaagaaacgttttggaagagtgaaaaaaacatttgaattttaaaagaagagtgatggaacagacatggcggaaaaaatagaaaagagaatcgaagaggtatgtgagcgcatgcttttttcagcgagaagtgaattatatctgcatctgcgttttcttgacgtagctttatcgatgttttcttatgcattagaaccgagtttggagacaatcggaagtgacggaagaatcatttattataatcctgcctatttaggggggatttaccgacagggaagagtgatggtaaatcgtgcttatttacatattgtgtttcactgtatttttgcgcatccatggaaagataccagaatccgtaaaaaaagagcaggttatgagcttggaatcaaaagagaatccggacaggaagatttaaccgatttattatgggacatttcctgcgatattgcagtggaacgaatgatagatgatctgtatctgcattgtatccgaaaaccgttatcaccgtttcgcaaagaaacctacgagtggctggaaaaagaaaagagtgtattaaatgcggaaagtattttttcggcactggtacatcgaaagacggatgaagcttttgcagggcggttaaaacaggaatttgaagtggatgagcatcgtatctggagggagcgaaatcgccaaaatcagagacagaatccaaaagaggattgggatgatatccgtgaaaaaatgcagacagagatggaaagctttggggatgagaaagataacggcgcagggcagagtatgcttgaaaaaatcaaggcagaaaacagagaacggcatgattatcggcagtttttaaaaaaatttgcggtgttaaaagaagaacagcagattgatgcggatgcatttgattatggcttttatgcgtatggattatccctatatggaaatatgccgctgattgaaccacttgagacaaaagaagtcaaaaaagtagaagagtttattattgcgattgatacgtcgatgtcctgctctggagaactggtcaagcattttttggaagaaacctggtcgattttaagagaaacggacagtttctttcatactgtaaatattcatatcattcagtgtgatgaagcagttcgaagagatgataaaattacttcaaaagaagaattagaagaatatatgaagaaccttgaaatagagggaaagggcggaacggattttgtgccggtatttacttatgtacaggagctgcttcgaagaaaagaattttccaatcttcgaggattattgtattttacagatggaaaaggaaggtttccaaagaaaatgccgccttatcagactgcatttgtgctggtgcaaaaagagtttgaagaggttgaagtgcctccatgggcaattcggatttatcagacagaagaagatggatatggattaggagaaaaaaaggatgaacattaaacgagccaaaaatgagattaaagatgcaattgaagcttatcttttaaaggatgaatatggaaattatctgattccggaaatccggcaaagaccgcttcttcttatgggacctccgggaatcggaaaaacacagattatggaacagattgcaagagagacaaagattaatctggtttcttatacgattacgcatcataccagacaaagtgcggtcgggcttccgtttattaaagaaaaagtgtatgataacaaagcgtattccgttacagaatatacgatgagtgagattattgcgtctgtctatgaacagatagaaaagacagggataaaagaaggaatcttgtttattgatgaaattaactgtgtatctgagacgcttgcaccgacgatgcttcagtttttacagtgtaagacctttggaaatcaggcggttccaaaaggctgggtgattgtggcggcaggaaatccaccggaatacaacaaatcggtacgtgaatttgatgtggttacattagatagaatccgaagaattgatgtagaggaagactttcaggtttggaaagaatatgcttatcaggcagggattcatccggcaattctggcttatcttgagattcataaacagaatttttaccggatggaaacgagtgtggatggacgtttatttgtgacagcaaggggctgggaggatttatctcagtttttatatgcttatgaacgtctggaaaaacgggcagaccgtgaagtaattggacaatacctgcagtactggaagattgcaaaagactttgcaaactatctggaactctttgaaaaatataaaacagactatcaaattgaagcagtgttagaaggcagatttgaaaaatttgcaattgataaattaaaaattgcttcttttgatgaaaaactcagtgtagtaggattattaatcggtcaccttggaaaagaattctatacctattatgagaatgatttgtttgtcacagaactgtttgaacggttaaaaaaattaaaacaggaattggaaaatgattcagaggaaaccgcaggtgcaattctcgaaaacagaattacaaaagaacaggaacggtttgagaaaaaagaagctgcaaagcagttaaccgttccacaaagaactgcattggttcggatgctttcatttttaaaatctgcgcataatgtggtcaaagagaaagaagaaaaaggaacaccaaaaggagaagtctttgaagtattagcaggattgtttaaaaaagagacagaaaagcgggaagaacagatagaaaaaacatcccaaaaattgcagtatgcatttgattttctggaattagtctttggagaaggacaggaattggttctttttgtgacagaattaaataccaatccgtacagtgtttcctttatcagtgaaaatggttgtgacagttattataagtataataaaaaattattgtttgaggaagaacagggcgagattttaaaagaactgaatcagatagaagaagagatgtaaaaacgactcctgcatacataaaagaaatgtaaatgtatgcaggagttttttggggtattattcgatgccgacttctttatgaatttcttcaattgcaagtttaaatccattttgtgcagctttcatacgccaggtgtccgctaaatcaatgtctttttcaacgccttctccatagcgatataagatagaaagattgtactgggcagcagggatatttgcgtttgcagctttttcaaagagctggaaagcacgttccggcatacatggaacggcctgacccatcaggaaataactgcccatacagcacattgcacggtagtcattttgttctgctgcttttttataccagtcaaatgcacggctgtagtcaacaacggttccgattccttcttcgtaacagcgtgccagattatattgggcatttttatctccggttttagccgctttttgaatatactccagagctttctttccatttttttctacgccttttccctgtgcgtaaaacattccaagatgcatcagtgcttccacatgatttttggaagctgctttttcataccattcagccgcctgcttaaaatctacttctgtgttaattccattttcatagtaatagccaacagcatactgcaaatctttctggccgttttcagcaaggatttttaattcatccagtgtaaattctgagtttttaaggttcatattttttctccaatttcctaagtatttcttctctctattttaaaacaataagaagtagaaagcaatggaatttctgaaagaaacgtattataataaagacaagttggggaaaataaaaaagtattcaaaagctggtttaaaatgcaggtttggaatacataggaaaaaggagaaggactatggtttataacaatgtacgacacgaatgtaatctttacaatttcttttttgcaccaaggggaaatcgtagaatgatggagcttgggcgaaaaattgcgcagatgtatttaaatccgtttgataagatcatcggaattataggggcaaaagactgcggaaaaagtatgctgattaagggaatgtttccgggaattcagattgtagaaggggacgacgaatttgattttcagaatatgccgctaatgaatgcagaagatgttggattttatacaccaagaacctttcatgtagatgtaagagccgcgtcaaaatttatttcgcttgaaaaaattgcacaggcaattttagatgtgacaaaacagcagaaaagagtcattgtagaatactttgagatgttgtatcctgtattaaacagaaatgcagatttgatgattggaattggtgaggaagtcattgtaacacgtccgtctttgtttggaccactgcctcaaaatattgccgatattgtatataaatctttgatttatcgtaaaatggcacacagcgcagaggatttatacggttatgtagtccgcaacatggagcgtccggattatgttcgttccgatattcgtcatggttttgtgctggattacgtagaaaaaccgattaactttgatttggaatatattgaagataagataaagagtctgattgcaaaggatttaccgattcgctattatgatgaggaacatatcaaaatcggagacgaaattcttgcatgtactggtcctctgatgcatgtggaaagtaccggacaaattgaaaatttctcgatggtaaaaaaattcttccatgatgcaagatttggatattatattgtagcgggtacggttgggcataaagaagaggaaagtgaccgtctcaatacgattgatattatgacagcagaataagaaccccaaaaggtcaggtaaaaacaaaacggacagtagagtaaacagaaaagaggataaaatatgatgttattagcgcagacagatttttattatgcaaacagaggaatgggctggggatttgatggaacttatgtgctgattatactggcttttttgatttcagcactggtttctgtaaagatgaatgccacattttcaaagtacagtaaagtgcgttcttactgtggaatgacaggagcacaggcagcacagcgtattttaagcagtgcaggaatttatgatgtcagaattgaacacgtaagcggaaaattaacagaccattacgatccttcaaataaggtgttacgtctgtctgatgcagtctatggaaatacttccattgcggcaatcggggttgcagctcatgagtgtggtcatgcagtacagcacgcaagaaattatgttccgttgtctgttcgttcggcaattgtaccagttgcaaattttggttcacagttatcctggccgttatttttagctggattaattttttcctttcgtccacttttaatgattggaatcttgctgttttgtgcagcacttttgtttcagattgtaacactgccggttgagtttaatgcttctgcgcgtgcacttcggatgctggatgagactggaattatggggaaacaggaaattcgtggaacaaagaaagtattaagagcagcagcgatgacttatgttgcagcagtcataggctccttgttacagcttttaagacttttgattttatcaggagcatttcgcagaagagatgactaaagagaacaagaggagaagaataggatgtttgagagaatcgattatatcgtaaagcagattgatggagattatgcttatttagaaagattagaaaagccagaaggacaggaagatgagttaaaatgtgttgcgcgcgctctgcttccaccggaaattatggaaggcagccgtctggcatatgaaatgcttcagtatacaataatttaagaatttaagaatttaagaaaatccctgttttgtattgatttggttatgagcaagtagcgaagcggattgcgaatatccacttgactcgcttgacatttacgaaacagggaaattttttatgaataaatgttaaaaatataacgaaaaatgcaagcgaaatagtctgaaaaattaggcagaacacaaaagaaataaataaaattcttgtataaaaagaaatacaagccaaaaaaataaataaaaataagattagctatacctaactattgtgtaaaaagtagaaaaatgtttattttttaacaaactattgctttttaaatttaatcttgatagaataagtacgaattaagaaatccgttttggatatcctaataagagattaagagactacgaaaaaatgctcaatgatgcaggaggaaatgacgatgaaaattttattttatgatacaaagagttacgataaagaatcttttgaaaaacagcttgcaaactttccggaagtggaaattgattttatgaaaaccgaccttgctccaaagactgcaccactggcaaaaggatttgatgcggtttgtgcatttgtaagctctgatatcggtacagagactgtagaaaaactgcatgaagcaggggtaaaactgattttgcttcgttgtgctggatttaacaatgtagatttagaaaaagcagaagagtatggaatcaaagtgatgcgtgttccgggttactctccggaagcagttgcagaacatgcgatggcactggcacttggagtaacaagaagactgcataaggcttatgtaaaagtaagagaaaatgattttagtttaagtggtctgatgggatttaatttttatcagaaaacagcaggaattgtgggaaccggaaaaatcggtgcagctatggcgagaatatgccgtggatttggtatgaatgttattgcttatgatgtttataaaaatccggatcttgattttgtagaatatgtttctttagatgagttattagagagaagtgatttgatttccctgcactgcccgctgatggataacacataccacttgattaataaagaaaccattgctaaaatgaaagatggagtggtacttgtcaacacatcaagaggtggtcttgtcaagacagatgatttaattgaaggaatccgtgcaagaaaattctttggtgttggtcttgatgtatatgaagaagagacaaagaatgtgtttgaggaccgttccgatgaaatcctggagcactccacaaccgcaagactgttatctttcccgaatgtaatgattacttctcatcagggattctttacagaagaagctcttgcagcaatctctgagacaacacttcagaatgcggttgcttttgaaaaaggagaaagcacaggaaatgaagtggtaaaacaggggtaagaatgaatcagaaaagaaattatcaaaaagaacttgaaactgtgatacaaaaggaacaaaaagaaggcagaactccgaaattgttactgcatagctgctgcgctccatgcagcagctatgtgctggagtatctgtctcctttttttgcaattacggattttttttataatccgaatatttcgccgaaagaagagtatcaaaaaagagaagaagaactaaaacgactgattgatgagatgccgatgaaaaataaacctgtatttctggcaggagaatatcatccggaagagttttatcaaatggcaaaaggattagaagatgtgccagagggtggggaacgttgttttttatgttaccggatgcgcctggaagaggcggcaaagatggcagttgagaaaaactgtgattactttgcgacaacactcacgatcagtcctttaaaaaatgcgcagaaattaaatgaaatcggagaagaattagaaaagaaatatggagttcgacaccttccgtcggactttaaaaagaaaaacggttataagcgttcaattgaactgtcaaaagaatacgatttatatcgtcaggatttttgtggctgtgtcttttccaaaagagagcgtgacagacgggagcaggaaaaatcgcttgcacctcaaaacagataatgataaactggtatacaaagcttataaaaaataaagaaatgagggacaaaagaatggctcaattatggggaggacgttttaccaaagaaaccgataaactggtatataattttaatgcgtccttaagttttgattccaagctttacaaacaggatattacaggaagcatggctcatgcatctatgcttgcaaagcagggaattatagaagaacaggaaaaagaagaaattttaaaaggcttaaaaagtattttagaagatattgaaaataaaaaactggaatttacagaagaatatgaagatattcacagctttgtggaagcaaatctgattgaccgttgtggagatgtcggaaagaaactgcataccggaagaagccgtaatgaccaggtagcactggacatgaaaatgtatgtcagagatgaaattggagaaattgaccttctattaaaagagctgttgacttctatttataagattatgtctgaaaatgtacatacttatatgcctggatttacacatttgcagaaagcacagccggttacgctggcacatcattttggagcatattttgaaatgttcaaacgtgacagaagccgtcttgcagatgcgaaaaagagattaaatctctgcccacttggaagtggtgcgcttgcaggaacaacttatccgcttgacagagcctatacagcagaagtacttggttttgacggtccgacattaaacagtatggattctgtggcagacagagattatttaattgaaactttatctgcgttatctactgttatgatgcatttaagccgtttctgtgaagaaatcattatgtggaattccaacgaataccgttttgtggaaattgatgacggatacagcacaggaagcagtattatgccacagaagaaaaatccggatatcgccgagttagtaagaggaaagaccggacgtgtttatggtgcgttaatgtccattcttacaactatgaagggaatcccactggcttataataaagatatgcaggaagataaagaatttacgttcgatgcaattgatactgtaaaaggctgtattgcgctgtttaatgggatgatttctactatggtgtttaacaaagacaatatggagaagagtgccaaaaacggatttaccaatgcgaccgatgcggcagattatctggtaaacaatggtgtaccgttcagagatgcgcacggaatcgtaggtcgtctggttctgcattgcattgacaaaggaatttctttagatgaaatgtctttagaagagtatcaggaaatcagtccggtatttaaagaagacatctatgaagcaatcagtatgaaaaattgtgtggaaaaacgaaatacaatcggagccccgggagcagaggtaatgacaaaagtattggcacttcataaaaaatatctggaagaaaattaaaaaacacttgctttttactaagttttggtatagtattgtttaggaaatacaaatgtacgtgaaaggaaaacacgatacataaaaaatagagaattggataagcaaggagaatttataatgagtgaaaaattaagagttggtattttaggtgcaacaggtatggtaggacagagatttatctctctgttagagaaccatccatggtttgaagtggtaacattagctgcaagtgcaagaagtgcaggaaaaacttatgaagaagcagttggcggacgttggaaaatggatactccaatgccggaagctgtaaaaaaattagttgttatgaatgttgcagaagtagaaaaagtagcttcaactgttgactttgtattttctgctgtagatatgagcaaagaagaaatcaaagcaatcgaagaagaatatgcaaaaacagaaacaccggttgtttccaacaacagtgcacacagatggacaccagatgttcctatggtagttccggaaatcaatccacagcactttgatgtcatcgaattccagaaaaaacgtcttggaacaacaagaggtttcgtagcagtaaaaccaaactgctctatccagagttatgcaccggtactgacagcatggaaagaatttgaaccttatgaagtggttgcaactacttatcaggcaatttccggagcaggaaaaacatttaaagactggccggaaatggtagaaaacatcattccatacatcggtggagaagaagaaaagagtgaacaggaaccacttcgtctgtggggcgaaatcaaagatggtgtgattgtaaaagcatctgaaccggttatcacaacacagtgtatccgtgttccggtattaaacggacatacagcagctgtatttgtaaaattcagaaagaaaccaacgaaagaacagctgattgaaaaattagtaaacttcaaaggtgttccacaggaattagaccttccaagtgctccaaagcagtttatccgttacatggaagaggataatcgtccacaggttactttagatgtaaactatgaaaacggaatgggcgtaagcgttggacgtttaagagaagatacggtttatgattataaatttgttggtctttctcataacacagtacgtggagcagcaggtggagctgttctgtgtgcagaaaccttaaaagcaaaaggatttatcacaaagaaataataagagataaataacgagagcaaaaaaatacatcaggccggagaactccctccggtctgattgcgtgaaagaggagtttatgggcaaatcattatttatagcagaaaaacccagtgtggcacaagagtttgcaaaggcgctgaaagaaccaatgacaagaaaagatggatatcttgagtcagaacatgccgtggttacctggtgtgtgggacatcttgtgacaatgagttatccggaaaaatatgatatcaaatacaaaagatggacgctggaaaccctgccatttttgccagaagaatttaagtatgaagtaatccctgcagtaaaaaaacagtttgagattgtaagcgggcttttaaatcgagaggatgttgagacgatttatgtctgtaccgactctggtcgagaaggagaatatatctatcgtctggttgcaatgatggcaggtgtaaaagagaaaacacaaaagagagtctggattgattctcagaccgaagaagagattttaagaggaatttctgaggcgaaagatatttcagagtacgataatttatcggaatcggcatatctgcgcgcaaaagaagattatctgatgggaattaatttctccagactgttatccctaaaatatggaaatgcggtgtcttcttatcttgggacacggtatcaggcaatatcggttggacgagtgatgacctgtgtgttgggaatggttgtcagaagagaacgggaaatccgtagttttgtgaagacaccattttatcgggttgtggcttcattggagacagaagatggagtcggaaaatttgatggagaatggcgtgcggtaaaaggcagccggtattttgaatctccaaaactttataaagaaaatggtttcaaagagaaaaaagatgccgaagagctggtagggattttatcgacggaatcaccttgtcaggctgtgattgaaaaaattgaacgtaaaaaagaaaataaaaatccgccgtttttatttaaccttgcagaacttcaaaatgagtgttccagattgtttaaaatcagtccggatgaaacgcttaaaatcgtgcaggaattgtatgagaaaaaactggtcacttatccgagaacagatgcccgtgtgctgtctacagcagttgcaaaagaaatttataaaaatcttcgaggacttcaaagttataccaaggctggagaatttgcaacagaaattttaaatcagggcagttataaaggaattgcaaagacaagatatgtcaatgacaaacagattaccgaccattatgcaattataccgaccggacaggcaatgaatgcgctaagaagtctttctctggcttcagaaaacgtttatgaaacgattgtacgcagatttttaagtgttttctatccacccgcagtttaccaaaaagtcagtctgatatccgttacaaaagaagaacggctgttttcttcatttcggattctgatagaggaaggttacttgaaagtaacacaaaattcctttgccaaaaagaaggcagaaaaagtggaaacggatgcaaaagaaggcgagcagatggaagataagacatttttaagtgttcttcagagtctgaaaaaaggaagcattttgcaggtaaaaggctatcagattaaagagggggaaacatctcctccgaaacgttatacttccggttcgatgatactggcaatggaaaacgcaggtcagttaattgaagatgaagaactgcgtgcccagataaagggaagcggaattggaacaagtgccacaagagcagagattttaaagaaattaatgatgatttcttatctttctttaaataaaaagacgcaggtgattacgccgactcagcttggggaaatgatttttgatgtcgttaatgtctcaattcgaccgctgttaaatccagagttgactgcaagctgggaaaaagggctgacgtttgtggcagagggacagattacaccggatgaatacatgcagaaacttgaacaatttattacagtgagaaccaatgcggtacttggacttagaaatcagttcgccctcagaagattttttgatgaggcatcggtttattatcagtcaggaaaaaagaaaagccagaaaaaggagaaaacaaatggaacagttaaaaatcagtgaattgtatcaggatttaaatcagacactcgcaaaagaattattagaaagcaagacgtatccatgggaagtactgcctctgattagcgaatttattgtaaaacttggcagtaccttaagtgaggaagaatatgaaaaacgtggagaaaatgtctgggtggcaaaatctgcaaaagtagcaccaactgcatttatcaatggaccggcgattatcggaaaagaggcagaagttcgtcactgcgcttttattcgcggaaatgcattagtgggagagggagcagtggttggaaattctacagagttaaaaaatgtaattttatttaataaggtacaagttccacattataactatgtaggagattctatcttaggatataaatcccatatgggcgcaggttcgattacctctaatgtgaaatctgacaagaagctggttattgtaaaagcaaaagatacgcagattgaaaccgggctgaaaaagttcggtgcaatgcttggtgatgaagtggaagttggatgtggttctgtcttaaatccaggaacagtagtgggaagtcattctaacgtttatccactttcttctgtacgaggtgttgttccggcaaacagtatttataaaaacaaaaatgaagtagttgaaaaacagtaagatgtactcttggaattttccgaggatgaattaaaaacgaaaagaggtttttatggaatggaaattttctaaaaaacagctgttgcctccggttttatcaggaagtacattaaaatggattgcaattgtaacgatgctgattgaccatatcggagctgttttatttgaaaacggatttatcaaagcctataatcagcagctttcgggcgcattttcttattctgtcactcatgcagtctggtatgcagacatctggatgagacgaattgggagagttgcatttccaattttttgctttttattagtagaaggttttttccatacatcgaatcgaaaaaaatatgcacttcgtctgggaatctttgcacttgtgtcagaggttccctttgatttagcgtttcgcagttcgattttggagtttacctatcaaaatgtaatggtgacgttgttcatcggatttttgacaatttgggcgatggaggtactgcgccggaaaaatccggcatggatggctgttgcagcaggacttggagtgttgaccggatatctggcaaggagtgattatggctggaagggaattattttaattctgattttttatttattttattatcagcccgtggaaaaaacgattgcaggctgtctggcacttttatgggaagcacccgcttgttttgcctttttgtcaattaatttatataaccatcaaagagggagaggacactctttcaaatactttttctactggttttatccggttcatattttggttttagttggaatccggtatgggctgtttggaatctgataaagtctaagagaaatcggtaggtatgtaaaaacttcaatggctatgagaaatccagaatatttccttgtgtagtattgctgagacgtgtataataaatacataaaaattagtagaaatcaccaaaggagagagcgccatgtggattttaagattcaaacctgtggattgtaaaaactgttataaatgtgtcagaaattgtccggtaaaagcaattcgggtaaaaaatcatcaggctcagattatgcaggatgcctgtattttatgtgaaaaatgcaccattgtctgtccccagcacgcaaaggctgagaaaaatgatgttccaagtttaaagagaatgattgcggagggaagagagcttgtagcaagtgtaaactctgcttatattgcaaagtatggagccggaagttttccttctcttagaaaagctctgttagagctgggattttcagatgtacgtgaaggtgcagagggagcttatctggtgaaacgagaatatgaaaggttgcttgaagagggagagaaggatgttatgattagctctatctgtccgtcggttgtccgtttggttaagattcattatccagaattgatggattccctgctttccgtattatcgccaatgcaggcacatggaaaatatttaaaagagcagaatcgagaatgtacgcttgtctatatcagtccatgtatttctccgattgcagaattaaatgaacagattaatgacgtgtcttatgttatttcatttgatgaattagatgactggcttgcagaaaatcagatgtgtatcgaagatgagaaagagaatgtagaaccgcgattgtcccgtatgcgtgcgcttgggggaggtatgagccggattatgaaaaaaaatccgaaatacagctatatgaacatagaaggaatcgataactgtattcgggttttaaatgaattaaaagaagggaatatccatcattgctttttggaattaaatgcctgcgatgggggctgtatcggtggaccgtctttccagacaagtaaagtctgccggcttcagagtcagcttgaactggaaaaagcttcgatttccgatgcctcaaatatagaaaacggcaaagattttgatatttccgaaaaaattaatatgagccgtgggattattggacgagttgtggaggaatcgtatccaacggaagaagaactgcatgaaattctggtaaaaatgggcaagacaagtccgttaaaggaattaaactgcggagcgtgtggttacaatacctgccgtgaaaaagcgattgcgattttccagaataaggcagaggtttcgatgtgtatgccttatatgagagagcgcgaagccagttatgcgaataagattatcaatgcgatgcctggtatgcttgtgacagtaaatacagaattaaacgtcatccaattaaataaagcagcaatggacttatttgatatccgaagaaagaaatctattatcggacagcctgtcagtgaattgatggatgactatgcttttgtaaatatgctgtcttatggaaaaacattctcacaggaccagatttttgtagaagaatttaaggtttatttagaccgtgtgctgacttatgataaaagcaatggtctgattatctgtattatgaaaaatgtaacaaaagaaattgcacagcagcaggaaattcaaagaacccgcattgtggcagcaaggatggcagacaaactggcagatgagcagcttcggattgtacataagattgcggaattgttaggagaaacagcggcagataccaaggttgccgtagaaaacttaaaagagacaattcttgcggagaaaaaagaagagaaacgtgaaaaaccggaggtttggttatgagagtgtattttgacaatctgtttgcggattttgcccatgtcagcctaaataagaaaaaagaatcgttgtgtggagatttttacatcatggaagaaagagggtctgataccgttttagtactctctgacggacttggaagcggtgtaaaagcaaatatcttagcaacattgacggcaaaaatgctttgtacgatgatgataaagaaaattcatctggaagaagcggtaaaaacgattgcagaagcacttccggtgtgtcacgaaagacagcttgcttatgctacatttcttgctatgaagattacaggaagacatgtttatcttgcgacctacgataatccgggactgattttgcttcgcaaaggaaaggtatttcattacgaagagaaaattcatttgattaacgagaaggaaattcgtgaagcagagtttgacttacaaaaagacgacatgctgattttgatgtcagatggtgtaacgaatgccggaatggggaagacaaccgatggaggctggggatatgaagaggttgaaaaattttgtgaacagaagtataaaccgaatctgagcgctcagcgtatggcggttgatattgcagaagcctgtgtggatttgaatttaaatgagacagatgacgatattacggtgcttacaatccgtctttgcgaaccgttagttacgaatctgatgattggccctccaagtaaaatggaaaaagacgaggattttttaagagtcttttttgaagaagaagggcaacatatagtgtgtggtggaacgactgcaaaatttgtggcaaactatctgggagaagaagtcgtaaccattaaggggtcagaaacagatgcagttccggcgatgtctgccttaaaaggggttgatatggtaacagaaggttatttgactttaaaacagcttgttacctattcaaaccgatggctgtctgacagtatggcggtgataagtatctcaaaacaaaaagatgcagctgcaaaactggcagtggaattatttgaacgttcttccgaaatcaatattttctttggaaatgcaagaaatccagcttataaagaactgaatattgattcgagtgaaaagcttcggctgacttataaattaaaagaacatttggagcgggcaggaaaaaaagtccgtatgaatatctggtaaaaaagaaaagtatctgtataggacaaaaaatcaaaaaagtccctgcagatacttttctggtttatcagaaaaaagttttgtcattctatagaaaccagaattaggattttgggaaaaagaaggacaataaaattttaattgcatagataatcaatagaaattaataaaaaattgaaaaattaataaaaaaattgaaaaatatagcagaaaaaaagtgttttaaagattaagtttgtgcaccaatcttgctgaaaatatagtataatagcccatatagaaaggggtgggcaaaatgacacgagaagaaaaattacaacgtgcgtctcaaatcatcaaagaaagtaaatatctggtgtgcctccttgggatgagggtgagttatcaaagtggatgtacgaacataggggagccggaggatgcttatgatatcgagagtcgatatgggtattctccagaagaattgtttagtgcagtgttttacaacaccagaccatctcagttttatgaattttataaaaatgaagttctcagcaaaagaggtagaataaatgagggtttaaaactgcttggtcaactggaagagatgggaattttaaaatcaattgtaacaagagacatttactctttgccaaaacgtgcaggatgtaaaaatgtactggaaatccatggaagcatttatcgaaatatttgtccaagatgcaggaaaaaatatccgttgaaagctttgcaggaaagagaaagaagtggacttccatattgtgaaaagtgcggttcgattatccgtccggaaatttacctaaaaggggagatgatagataatcgtctgcttacaaaagcagtagatgaggtttcaaatgcagatgttctgttgatgctgggctgctcgatgcgttctgacctgggaagtatgtttacgaagtactttaagggggaaaagattattctgatgaatgaccaggatcattttgcagatggaaaggcagatttggttatcgatggaaaagcgatggatttgatgaaaggacttagaacttacatggtctcggatagttgaatttaagcaggaagatcggttacttacagtcgagtagttcacatgggcatgcgcttgcataaatgaaaaacattacataaaaaaataaaaaaagaaatactttacaaagtgtaatgcaggagatataataaggaatgtattttgattatctggaggagatagagatatgatagagaaaaagatggaattattagaagaagaaaatgaccgtttaaaaaaagagatagaaaatttaagagaagcttgtaaagttcaggaacagacaatttcaaagttatggaatgcttatgttcagttagaagagaaagtaaatgataagtaaaaatcaataagcagagaacagaaataaaaaaaggttatcaccgcagaagtacggtggtaaccttttttgttagataaaaatccttaattttaaaggagttcttagaatttaccagctttagcagcttcctcaacggctacagctacggctacagtcataccaaccattgggttgttaccggcaccgattaatcccatcatttctacgtgagccggtacagaagaagaaccagcaaactgagcatcagaatgcatacgtccaagtgtatcagtcataccgtaagaagcaggacctgctgccatgttgtctgggtgaagagtacgtcctgtaccaccgccagaagcaacggagaagtattttttaccagcttcgatacgttcttttttgtaagtacctgcaactggatgctggaatcttgtcgggttagtggagttacctgtgatagaaacatcaacgtcttctttccacatgatagcaacaccttcacgaacatcatttgcaccgtagcagttaacttttgcacgaagtcctgtagaataaggttttctgaatacttcttttaattcgcctgtatagtaatcatattctgtttcaacataagtaaatccgttgatacgtgcaataatctgagcagcatcttttccaagaccgtttaagataacacgcagaggctctttacgaactttgtttgctttttcagcgataccgatagcaccttcagcagcagcgaaagattcgtgaccagctaagaatgcgaaacattttgtatcttcttcaagaagcatttttcctaagttaccatgtccaagacctactttacgctggtcagcaacagaaccaggaatacagaaagactgaagaccttcgccgattgcagcagcagcgtcagcagcttttctgcagccttttttgattgcgatagcagcgcctactgtgtaagcccatttagcattttcgaagcagataggctgaatgccttctaccattttgtaaacatcaagacctgcagcttttgttacttctgcagcttcttcaatggtattgataccgtatttgttcagagcagcaagaacttgcttctctcttctttcatatgattcaaataaagccattaatttatcctcctattctttctatgacagtcgcagtgataaaaataaattatgtaatcagtcgtcagaaattattcttttcttgggtcgatgattctcactgcatcgtcaacacggccatactgtccctgagctttttcaaatgcagtatttgcatcatcaccagctttgatgaagtccatcattttaccgaagttgatgaatttgtatccaatgatttcatcatcttcgtcaagagcaacacctgttacataaccgtctgtcatttccagataacgaggtccttttgcaagagttccgtacatagtaccaacctgagaacgaagacctttacctaaatcttcaagaccggcaccgattgtcagaccattttcagagaaagcactctggcttcttccgtatacaatctgtaagaacagttctctcatagctgtgttaattgcatcacatacaaggtctgtgttaagagcttcaagaattgttcttcctggtaaaatttcagatgccatagctgcagaatgagtcataccggaacatccgattgtttcaactaaagcttcctgaataataccatcttttacatttaaggttaatttacatgtaccctgctgaggagcacaccagcctataccatgagtaaaacctgagatgtctttgatttcttttgcttttacccattttgcttcttctgggattggagctgcgccgtggtttacaccctgatgtaccggacacattgtttctacttcgtgtgaataaatcattttaaaactcctttcaagaatatataattcaagtgcgttagaaatttaacgtcctattcttcattattgtctcataaaaagataaaaaaatccagatctatttcaaaaaaaattgaatccagaaaatttaaacaatgaaaatggtaacatagttgagtttggaaaataaaaatggtatgatgaaaataaaataaaactgcataaaaaaggcagagaaagaaggcaaaaatgagagtggcaaactattgggagggaaagcattatgcatttttctgtaataaagaatgtgaattttttccatgtcatcagacgaaacatccggaaaaattcaattgtctgttctgttattgtcccctgtacgcattaggagataaatgtggaggaaatttccagtttacgagagatggaatcaaagactgcagtaactgtgcgcttccgcataatccggataattatggatatataaccggaaaatatcaggaaattatggaaattgtaaagcagaatgcggatttaaaagaagaaaaataagaaaaacaggttacaaaaaccaaaatgattgatggaagaaataagatggtttggacttccaaaatttcgtatatcaaggtataataggacaacagaaaaatgtaaaacactgtctctcaagaagaaacagagacggtaaaaaataagatgtatgaaagaaaatgggagggcaaagatgtatcaggcattactttttgatttggatggaacattgacagcatcaggagagggaattacaaaatccattcagtatgcattaagaaaaatggggtatgaatctcttgcggaagatttgaaaaaattagaagtttttgttggaccaccgcttttagaacagttaatggaatactgtcagattgaggaaccggaagcagaacagggcgttgcctactatagagaacgttacaatgtggttggatattatgagaataaaccttataaggggattcgcaagcttctgccaaaattaaagaaaaaaggctacaaactggcagttgcttcttccaaaccacagggaatggtagatgcagtgcttgaacactttgaactcaatgaatattttgatgtcatcgagggtagtgatgtcaattttccaagaatgacaaaatcagatgtgattgaaattgcactaaaaaaactaggattttttgaagcagaaaaacgaaaaggtgttgtcatgattggtgacagaaaatatgatgtggctggtgcgacggcgtctcggcttgattgtattggagtcgcttatggatatggcggaacagaagaattagaatcagcaggtgcgataaaggtagtacagacggtagaagaactcggagaatttttgggagtcagtaaaaaagccagattccatgatattggaaaagagttattttccacaccggtttatccgggagacccggcaccgtcaaaaactccattctatgaaattaaaaagggagatgactgtaatcttaccattctttcttttggaagtcataatggaacacacttagatgcaccgaaacatttctgtgaaggcaaacatggagttgaccagattccacttgaaaaatgtctgggtgaatgtaaagtgataaaagctgagggtgtaatcggaaaagaagagatggaagctttattagcagatggtacaaagaagcttttaatcaaaggagaaattcttctgacaccggaaagtgcaaaagtatgcgtagaggccggactggatttgattggagtagaaagtcagaccgttggaggaaaaggaacgcaaaaagcggtgcatcagactttactttcagctgaaattgtaattttagaagggttagtgttaggagaagtgacacaaggaacgtattttttaagtgctctgccgatgaaaatggaagggcttgatggctctccggtcagaccggtattgattgagtattaagaagaaaaaagagctatctctgataggtaaaaaaataaccggacgggttttcctgtccggtttgtatgttaaggtttaaagttcagctaataaaatcgcagcgaacataaggacacagccaatcaactcccgtgtgcttaaagtctgatgtaaaatcacccatccggcaaggacagagatgacagattccagacttaaaattaaagaggcaatggttggatttaaatttctctggccgataatctgtagggtataagcaacaccgcaggaaaggattccggcgtataaaatcggtgcccaggctgcacagatactggaaagctttggattttccagcacgaacattggaatcgcagataacattgaggcaataaaaagctggatacaggagagtttgactccgcttactttagaggaaaagtaatcaactactaaaatgtgaaaagagaaaaataaggcaccaagaagtatcagggcatctcctttggtaagtgtaagacttccactcatacataacagataaagaccaacaagggcaatcaatacactaatccagatttttaaatttacttttcgtttcaaaaagatacccagaatcggaacgatcacgatataaagtgcggtaataaatccggcttttccgactgaagtatataaaattccgatttgttgcaaagaagtcgcaataaaaaacagaataccacaggagatacctccaagaatgctctcttttggtcggtcatgcaaagtatctttgtcaactttttttgcagtacgtttttggttccagaagataacaggaattaaaatgaaactgccaacaaaacaacggacagcattaaaagtaaaaggaccgacgtagtccattccaacactttgggcgacaaaagcaacgccccagataaaagcggcgagaaataaaagcagagagcttttgaaagatttagttttcataatagaaaaactccttcatatttgtatagtttgtatagattatagcattcaaaaaagtaaactgcaattacagaataaaagatagagaaaatagaggagaaaaaagaaatgatagcaaataaagaagagattagagttgggcaggttattgtacacatcttagattctaccgttgggatgcctgtgctttctgacacagtattagattatggttcagactttgctgattttataaaagcacatatctttaaaacagataacagtgatgatatcagaagatgcgtatttgaagaagagtctgcaatttatagttatcttcaagaatggaacagtgaaaattttgtagatctctcaaaaaaaatagcggaagaattatttacgattatgaatcagaatattgaaattccacaggccgatttaataatagcagaatatgaattggaaaaacgaaaatatcttgcaattttaaaaatggattataagagtttttacactcatttgaccaattcggatccgtggggaaataataatgagattatcagacaaaaagcgattttgccaggggaaaaccagaaactttcagaggcagctctcctcgattttgaagcccctcaatatgtgcgtttgaccgaaaagaagtatgagataaatggtgtcaaatcctattatttttcaaagttattcttaaaatgcaaggcatcgctttccgcaaaaagccggttaaatcttgtcagcaaagcagtatccgaggttcagaaaaaattttatcatgaatcggaacagtttgaagtccagatggagacaaagagtattattaatgaagagttttctaaagatggagtacttgatgtaccggttgtaatggataaaatttttaaagaacatcctaatatgagaaaagaagttgaagaaaaattagagaaatacaatcttgcaaatacaactgtagagccgcaaaatccgacaacgacgaaaaaatttaccaaacagcatctgatgacggacacgggtattgaattgaaaattcccatggaagaatataacaataaagacagaatagagtttattaccaattcggatgggacgatttccgtgttaattaaaaatatcggctgcattgaaagtaagtagaaaacatgatataatatattgttttcagtcaaaaaagaaaagtaggaggttttactgaatatgaaacgagaaaagttttcttccagactcggatttattctgatttcggcaggatgtgcaatcgggcttggaaacgtatggcgttttccatatatttcgggaaaatatggcggagcggcattcgtactgatttacttattctttcttgcaattttaggactgccgatcatggttatggaatttgcagtcggacgtgcaagtcagaaaagtattgcaacttcctttaatgtacttgagaaaaagggaagtaagtggcatgtttaccgttattttggtatggcgggaaattatctgttaatgatgttttatacaaccatcggaggctggatgcttcagtatttctttaagatggcaaaaggtgattttgtcggattaaatgcagaacaaatcagcagggtatttggagaggtttccacaagcaaaaacagcatgattttctggatgtttgtgattgttgtacttggatttttagtctgctctcttggactgcaaaatggtgtagagaagattactaaagtcatgatggtagtgcttctggcattgatgttggtgctggcagtccgctcctgtacgttagatggtgcatcagagggattaaagttctacttgcttccggattttaagaagctgacagaatataatgtcacagaagttgtatttgcagcgatggggcaggcgttctttactttaagccttggaatcggtgcacttgcaatttttggaagctatattggaaaagaaagaaaactgaccggagaagctatcagtattacaattttggatacctttgttgcaattgttgcgggattgattattttcccggcctgttttgcttttggcgtagaccctggagaaggaccgggactggtatttgtaactctgccaaacgtatttaacgcaatggcaggtggaagagtctggggaacattcttctttttatttatgacatttgcagcgttatctacaatcattgcagtattccagaatatcattgcatttgcacaagatttatggggatgggggcttaaaaaggcaagttttgtcaatatgattgcagtatttgttttatccctgccatgtatctttggaatgaccatctggagtgactttacgattcttggaaaagatattatgggatttgaagatttcctggtaagtaataatttattaccacttggttctttagtttatctgatgttttgtgtctctcgttatggatggggatgggacaacttcttaaaagaagcaaatacaggagcaggaatttctttcccgaaaaaaattcgtttttatctgaactatattctgccgttgattgtactgtatatctttttccagggatactggagtctgtttcagagtttatagaaaaattccttgaaatcgcttaagtttacaggtatacttaggtcaggatatgcaaaaaggcagatttaagaagatttaagaatggaagaaatccttaaaactgtcggaataaaaaattaggaaatacaagaggaaaaaccatgaagagaattttattaaaattaagcggagaagcacttgcaggtccaaaaaaaacaggatttgacgaagcaacagttatggaagtggcacgtcaggtaaagactttggtggacgagggaattcaggttggaatcgtaattggaggcggtaatttctggagaggccgtaccagcgaaaatatcgaccgtacaaaagcagaccagattggtatgctggcaactgttatgaattgtatttatgtgtcagaaattttccgtgcagcaggaatgaagacaaatgtactgactccgtttgaatgtggttcttttacaaaattattctcaaaagaccgtgcaaacaaatattttgaaaaaaatatggttgtttttatggcaggtggtaccggacatccgtatttttcaacggatacagcaactgtacttcgtgcaattgaaattgaagcagagactatcttccttgcaaaagcaattgatggtgtttatgacagcgacccgaaaacaaatccggatgcaaagaaatatgatgaagtcagcattgatgaagtcatcgcaaagaatttacaggttgtagatatgaccgcttctattttatgcagagacaataaaatgccgatgctggtatttggtttaaatgaaaaagacagtattgtaaatactgctcatggaatctttacaggaacaaaagtattggtataaaagcaggagggattttttaatatggcagacgaaagaattgaaaaatatgaaagcaagatgacaaagactcttgagagtctggaaaaagaactgtccacagttcgtgcaggacgtgcaaatccgcatatcttagataaaatcacagtagactattatggagcaccaactccacttcagcaggtagcaaatgttacagtaccggaagcaagaatgatacagattcagccttgggaagcatctttaatcaaggaaattcagaaagcgatcctttcttctgatttaggcttaaatccaaatacagatggaaaaataattcgtctggtattaccggagctgacagaggaacgaagaaaagaactggtaaaagatgtaaagaaaaaaggggaagctgcaaaagttgcagtccgcaatatcagaagagatgccaacgatgcgtataagaaactggcaaaacaggatgtgtctgaggatgaaatcaaagaactggaagacaaaatccagaaactcacagacaagtttgtgaaaaatattgacaaagcagtagaagaaaaatcaaaagagattttaactgtataagctgtataaaacagagggggcacatacatattacgtattgtgccccttttatgcgtaggaggaaaaaatggtaataccgaatcatgtggcaattattctggatggaaacggacgttgggcaaaaaagaaagggatgccaagaacgtatgggcatgtcaaaggctgtgaaaatctggaaaaaatctgttctgttgcaaaagaactaggagtaaaatatctgaccgtatatgcattttctacggagaactggaaacgatccaaagaagaggtggatgcgctgatgaaattattccgtaattatatgaaaaagtgcattaaaatttcaagggataataagatgcaggtacgtgtcattggagatccgacagcatttgaccctgatttacaggaaaaaattaaagagttagaagaatattccagtcagtacgatgaattatattttcagattgctttaaactatggaagccgtgatgaaattaaaagagcggtacagaagatggcagaggatgtaaaagcagaaaagttaaatccggaagaaatttcggaacggacgatttctgattatcttgacacgaaaggacttcctgacccggatttgttaatccgcaccagtggagaagagcgtctttcaaactttttaatgtggcagcttgcctatacagaattttattttaccgatgtggcatggccggattttaataaagcagagtttgaaaaggcaattgcaaaatacaatcagagagaccgtcgttttggtggggtaaaggaggagccggcaaatgtttaagacgagactgattagcggaattattctggtcatcattgcacttgcaacgattattccgggaggtccggtgctttatgtgactttgcttgcaatttctttgattggcatgcaggaattataccgtgcgatgaaagtgcgtgagaaaaattttaattttctggaacttgcgggttatgccggtgcagtttgttattacctttctttattaaaaggtggagaactcccgcagatggcattgatgtttgcacttgtgctcttaatggctgtgtatgtattcacgtatccaacctatcatgcagaccagattatgtcggcaatgtttggaattctctatgtggcagttatgctttcttacatctataagacccgatgcttagaaggcggtggctggctggttggtctgatctttttaagctcctggggaagtgatacctgtgcatactgcgtgggaatgttgattggaaaacacaagatggctcctgttttaagtccgaaaaaatcagtagaaggcggagttggtggagtaatcggcgcagccctgcttggtgcaatttatgcactggttatctcaaattggaatggtacgtccactcatacgcctcttatgtatgccttaatctgtgcagtgggcgcactgatttccatggtaggagatttggctgcatcggcgattaagagaaataaagaaattaaagattatggaacattaattcctggacatggcggaattttagatcggtttgacagtgtaatctttaccgcaccgtttatttattttctgtccatgatacttttgtagaaaggattgaacttacatgaagaaaattgcgatattaggttcgacaggttcaataggaacgcagacgcttgatgtcatcagcaaaaaagaagatttggaagtggtcgggatttctgccggaagcaatattgagatgcttgaagcacagattcgtcggtttcatcctcttttagcagctgttggtgatgaaaaaaaagcacaagaattaaaaatcaaagtggcagatacaaactgcagggtagtcggtggaatggatggacttttggaacttgctcagatggaagagtctgatattttagtgactgcgattgtgggaatgattggaatccgtccgacaattgccggaattgaagccggaaaagacattgctctggcaaataaagagactttggtaacggcagggcatttgattataccgcttgcaaaaaaatgtaaagtgcggattcttccggtggacagtgaacacagtgcgatttttcaggcattaaacggagaagaaagcagacggattcataaattattagtgactgcttcgggcggtccgtttcgtggaaaaaaacgggaagaattggaaaatgtacaggtagaagatgccttaaagcatccaaactggtcaatgggacagaaaattacgattgattcagcaacactggtcaataaagggttagaagtaatggaagcaaaatggctgtttggagttccggttgaacagattcaggttgtcgttcagccacaaagcgtgattcattcaatggtggaatttgaagatggtgcagttatggcacagcttggaaccgcagatatgcgtctgccaatccagtatgccttatatggcggagaacgtcgctttttagatggagaacgtctggattttgcagcattaaaatcaattacatttgaagaacctgatatgaaaaccttccgtgggcttccacttgcaatcaaagcatcgaaaattggcggttctatgccgacggtgtttaatgcggcaaatgaaaaagcggttggaatgtttttgaaaaagcagattcgttttcttgacatttattcaattattgaagaaaccatgcagacacatactgtaattgagcgaccggatgtagagacaattacggaattagagcaggatgtatatagacagattggaggcagatggtaagttgtcgaagctattaaatatactcgtcgcgattattatcttttctgtgattgtagtgttccacgaattaggacattttcttctggctaagaaaaatggaattgaggtaactgaattttctcttggaatgggtccacgtcttttatcgacggtaaaaggaaatacacgctattctctaaaactatttccaattggcggttcctgcatgatggtaggagaagacggagaagaagatggaccaggttcttttgggcatgcatctgtctggggacgaatcagtgtagttgcagccggaccaatatttaattttattcttgcatttgtgtttgcattggtcattacgagtgtgatgggatatgacccgccaaaggtactttcggtggaagaaaattctccggccgaagaggcaggattacaagtgggagatatcattacgagttttcaggggaaacctatttccatcggcagggatatcagtttgtatgaatctctttatggaatgcagcaggatcagattaagatgactgtaaaaagagacggaaaaaagattgatttaaattttaaagctgcaagtgaaaagaaatatatgttaggcttttcttatgttccggatggagaaccggaaattacggaagtctttgtcgatggagcgatgatgaaagccggagtgcttgcaggagatgtgattaccgcagtagatggaacgaaagtttcgacaggagaagaacttcagacgtatctgggagagcatccgcttggagagaatgctgtgacgattacggtttcgagagatggaaaagagaaagaatttacggttcaaccaacggtacggacacaggtcagcactggatttgtctataatctgtatcgggaaaagacaaatttctttggtgtgttaaaatacagtgcagtggaagtccgatattggatttcaagtacgattgacagtttgggactactaatcaaggggacgtttcgtgtcaacgacctgtcaggtccggtcggaattgtagatgcaatcggaagttccgtagaagaggcaaaatcagagggaaccgttgtgatgtggatgcagatgttctactgggcaattctgttatctgcaaacttaggtgtcatgaatcttcttccgcttccggcacttgatgggggacgactggtatttttactgattgaggcggtaacgaaaaagaaagtcaatccgaatatcgagggaatgattcattttgccggatttgtacttttaatggctttgatggtttttgtatttatgaatgatataaaacgtttataatggaaagaaaaatggtttgaggttttgaccttgaaccattttttcacgttttgggaaagagaggcatatcttaaagcgatgagccttttgaggtgttttatgcgaagaaacggactaagagcaatgcaaaatgaccagattgataaaggcggtcttaagatttcagttgtttcgtcgaacagaaatcgtccaattgcaaatgcgaggattgaaatcacttatacaggagacccggagaggattgtagagcgtctgataacagatgaaaatggtcagattcctgaaattgaattgtcagcaccgccgattgagtacagtatgacgccgtctgagtatcagccgtattccgagtatgattttcggattacggcggatgagtttgaaccaattacaatttcaggtgcagaaattctgcctgagattactgcacttcaaacgataaaactcaatgagagaagtataagagaaccatttgaggttattacaattccagaccataccctgtatggaaattatccaccgaagattccggaagatgagattaaaccggtggatgaaagtggagaaattgttttaagcagggtcgtaataccggaatttattgtggtacatgatggttcaccggaagactctacggcaaatgattactatgtgcgatatcgggattatattaaaaatgtagcttcgagtgaaatttatgcgacctggccgagagaaacgattaaggcaaatgtactggcaattatgtcatttactttaaatcgggtgtatacagaatggtatcgaaacaggggatatgattttacgattacttcctctacagcgtttgatcataaatggatttttggaagaaatatttttgatacgatttcagaagtggtagatgaaatcttttcgtcttacctgtcacggccgggagtacgtcagccgattctgactcagtactgtgatggggaacgggtttcgtgtcctggctggatgacccagtggggcagtaaatatcttggggatggagggtattcggccattcagattcttagaaatttctatggaagtaatctgtacattaatacagcagaggaaatctcagggattccgctttcctggccgggatatgatttggatatcggggcttccggagataaggtgtcacagattcaggaacagttaaatgcaatccgtgaggggtatccggcactgccgaaggttcgggtagatggaatttatggagaaggaacacaaagagctgttcgggaatttcagagaatctttgggcttccggtgacaggaatcattgactatccaacctggtatcggattcaggatatttatgttggagtgacaaggattgcagaattagtataattggttgaattgtttgaattgccaatatataaaaagaaattatttaaagattccattaaaagataaaatatttcaaaaagaaagataaattattcacaaatacagtatggataagccataaaatatgttgcataatgaaggggagaaaggatacggtaaatggattggaaaaaggagaagataaatttatgaaagaacaggataaaagattacaggatttaggggtacagatttcaatttatcggaaacagaaaaagatgacacaggcacagttagcagtagagattggtattagccggacacatatgagtaacattgaggcattgaatatgccgactcagatttcggtggatacattatttaagattgcggatgtactgggaattaaagtttctaatttgtttgaagagatttaaataaataatggggtatgatatgagtcagtaaagtgggcattcgcaatccgcttatctgcatttggaaaaattctatatgaatcagagtagaacaggaatgtctactttacaaactgatgaaaaagcgatagaataagaccagatgaaaataaaaaagaacagggaaaaaggctgtcaggctaaaagaactcttttggcaggacagcttctttttttcaggcagatggaggatgcatgtatggcaaagtatatgatggcgctggatgctggaacaaccagcaaccgctgtattctttttaatgaaaagggggaaaaagtcagtctggcacagaaagaatttacccagtattttccaaaaccaggctgggtggaacatgatgcaaatgaaatctggtcaagccagcttggagttgcggtagaagcaatgcagaaaatcggggcgacggcttcagatattgcgggaattggaattaccaatcaaagagagacggcgattgtatgggataaaaagagtggagaaccggtttatcatgcaattgtatggcagtgcagacgaacttctcagtattgtgattccttaaaaaagaaaggactcaccgaaacatttcgccaaaaaaccggtttgattgtggatgcgtatttttcaggaacgaaaattaaatggattctggaccatgtagagggagcaagagagaaagcagaaaagggagaactgctttttggaacagtggagacctggctgatttggaaactgacaaagggggcagtgcatgttacggattattccaatgcttcaagaaccctgctttataatatcaatgaattaaaatgggatgaggagattttagaagaactccagattccgcgcagtatgcttccggaagtaaagccatcaagctatatttacggaaagacagatgcaagttttcttgggggagaaattccaatcgccggggcagcaggtgaccagcagtcggcactgtttggacagacttgttttaataaaggagaagcaaaaaacacttatggaacaggatgttttttattgatgaataccggagaaaaaccagtcttttctaaaaatggactggttacaaccattgcctggggactggatggaaaagtaaattatgcgcttgagggttcggtgtttgtcgcaggagcagcaattcagtggcttcgggatgaattaaagattattgacagttcagaagattcggaatacatggcaaaaaaagtggaagataccaacggctgctatgttgttccggcatttactggtctgggtgcgccatactgggaccagtatgcgagaggtacgattgtggggctgacaaggggtgtaaataaatatcatattattcgtgctacattggaatccatcgcttatcaggtgtgcgatgtcgtaaaagcaatggaagcagattcaggaatttcgctttcttctttaaaagtagatggtggagcgagcgccaatgattttttgatgcagacacaggcagatatcgttcaggttccggtaaaacgtccaagctgtgttgagacaactgcaatgggagctgcctatcttgcaggacttgcagtcggatactggaaaaacagagaagagattattaaaaactgggaagtggaacaaagctttgaaccggttttagaaaaagaagagcgggataagaagatgaaaggctgggagcgtgcagtgacctgttcttacggttgggcaaaagaggatgatgaaaatgagtgaagaaaatctggaagtaccgtttgaatttggcgaatgtcatgcccatatttttatggatgggaaaaattataaaaaggcagtggaacgtcataaaaacggagtagatgaatcggtaatccgcagtcattttgcatgttatcaaacacagggaattcattttgtgagagacggaggtgacgctcttggcgtttcaagacgagcaaaagagctggcaccggaatacggaattgattatcggacaccgatttttgcgattcataaaaatggtcattatgggaaaattgtcggaaaaggatttgataccttaaaagaatatacggctttggttaaggaagtaaaaacacagggcggagattttattaaaatcatgacaaccggaattatggattttgacaccgatggcggaattaccggagaagctttaagagcacaggaagtcaaagagatggttcatattgctcacgaagagggatttgctgtgatgtgtcatacaaacggtacaaaagcagtggaggcactcatagaagccggagcagacagtgtggaacatggaaattatatggaggagcagacaataaagagtctggctgattccgatctggtctgggtaccgacagttacagttgttccaaatatgtttggatgcgggcggttttcggatgagcttctgcataaaatttatgaaaaagaaaaaacgaatatcaaaaaaggacttcagtatggagtaaagatggcacttggcagtgatgccggtgcatatctggtgttccatggtcagggaattttagatgaatatgcaagatttctggaatgcagaaaagaaattcaagaagagagtcaggaaaatgaacaagaattcctgtcggtttgtgagttaaaagcaaggctgaaagctggagaagcagaaattagaaaaaaattcaaaaaaatcgaaaaaagttattgacgaaataaaactttggtgatatacttctgtttgtcgcttgatgaggacggcaaatgagaagcgggagtgctggaattggcagacaggctagactaaggatctagtggtcgaaaggtcgtgtgggttcaagtcccatctcccgcataacagaggcggaaaacttttagagataaaggttttccgcttttcgttttatataaataatattgtgatgtaagaaaaagtgcatctttctttttatgaaaaatacattgattcgtgaatttattgcaaaaaacgataataaatgatgttatcagaaaaaaataaagtttttttcaaaaatatgttgacaaaacacgaaattactgatatacttctgattgtcgcttgataagggcgataaatgagaagcgggagtgctggaattggcagacaggctagactaaggatctagtggtcgaaaggtcgtgtgggttcaagtcccatctcccgcataacagaaacggaaaagctattagagataaaagcttttccgttttttcgtataatcaggaagacagtttttcgataaaagaagaaagtgagaattaagaaaaaaatatcgaaaaacaaaaggattttacagatttgcctgtaataattaatatgagacaactttttttccacagagagggtgatagatcgtgacaatacgagaagaagcgcaactggaagaggaaagaattttaagtccttatgcagcaaaaagtgcaaaaagcagaggacgggaaacttatgaggaagaatgtgatatccggaccatgtatcaacgtgacagggaccggataattcattctaaagcatttcgcagactgaaagataaaactcaggtgtttttagcaccgcaaggggatcattaccggaatcggctgacacatacaattgaagtatctcagattgcaagaaccattgcgaaagcacttcgtttaaatgaagatttagtggaagccattgcactcggacatgatttggggcatactccatttggtcatgcgggagagcgagccttagaccaggtgtgtccccttggatttgcgcattataaacaaagtgtgcggattgcagagcgtctggaacgaggtgggaagggattaaatcttacctttgaagtcaaagatggaatgatgaatcacaggacaagcggaacaccgcatacgctagaaggacaggtcgttcggattagtgataagatttcctatattcatcatgatatggatgatgccaagcgtgccggagttatcaccgaagaggcagtaccaaagtatttgagggaacttcttggagagacgacaaaggaacggctcaatacgttgattcatgatattgtaaagaacagcaaaggcagggatgaggtcctgctgtcaccggaaattgaagcaggaatgaaagcacttcgagagtttatgtttgaagaggtttatctaagtcctgtggcaaaagaagaagaggagaaagcagagcagttagtggagactctgtataaatattatgtaagaaatcctgaaaaaatgtcggcagagtatcgaaagcttctgaaagaaggagaagtgcaggagcgggtagcctgcgattatatttcaggaatgacagaccagtactcgatggaaaaattcagggaaatttttattcctaaaggatggagcgtttattaattatgtattattcggatgatgtgattgaagaagtccgtatgaaaaatgatattgtggatgtgatctcaggatatgtcagacttcagagaaaaggaagttcctattttggattatgtccgtttcataatgaaaaatccccttccttttcggttagcccatccaaacagatgtattactgctttggatgcggagccggaggcaatgtgtttaatttcattatggaatatgaaaattttacctttattgaggcagtaaaatatcttgcagacagagccggagtcaagcttccggaacaggagtattcaaaagaagcaagggcagcggcagatttaaagatcattctgcttgaggtaaacaaaaaagcagctgcttattattactatcagctgagacaggaaacagggaaaaaagcactggaatatctgcagaaacgagaattatcagaagaaacgataaaagcgtttgggcttggatataccgggaattattcagatggtctgtatcggtatttaaaatcaaaggggtattctgaccagattttaaaagaggcagggcttttcttctttgacgaaagacagggaatgaaggataaattctggaatcgtgtgatgtttccgattatggatgtcaataaccgtgtgataggttttggtgggcgtgtgatgggagatgcacagccgaaatacatgaattcaccggaaacaaaaattttcgataagagtcgtaatttatatggactgaatattgcaaggcgaaccagaaaaaattatttaattatctgtgaaggctacatggatgtgatttccatgcatcaggcgggatttaccaatgcagttgcatcgctcggtacagcattaacttcggggcatgccagtctgatgagaagatatacaaaagaagtattattaacttatgacagtgatgaagccggtcagaaagctacacttagagggattccgattttaagaggagcgggacttcgaccgaaagtcgtaaatctggcaccttataaagaccctgatgaatttatcaaggcagagggtatggaagcgtttgaaaaacgacttgaaaatgcaatgaattattttctgtttgaggtacaggtcttggaaaaagagtatgattttaatgacccggaaagcaaaaccgagttctatcgcgcaattgcagaaaagttattagaatttccagaggaacttgaaagaaataactacattgaaagcatttcaaaaaaatatcagattctgccggaagatttacggagaatggtaaacaatatggcactttcgggtcggagagtgacacagccaaaagctgaaaatctgacagacagaagaaaagcaagaaaaaaagaaagtggaaaagaagcttcccaaaaactgatgttgacctggctgacttcttatccaaaaatgtttgagacaataagtggctatattacgccggatgattttacaacaccgttgtatcaggaagttgcaaagctgctgtttgcgcagtatgaagaagaacacgcagtcaatccggcaaagcttttaaaccgctttacggacagtgaagaacaaaaggaagtgacatccttatttcacgcaactttgcatttggagggagatgaagaacgcaaacaggcgattcgtgaaaccgtatgcagattgaaacgggacagcatagcctatcagacatcaaatctggcaccgacagatatgattggactgcaaaaacttttagaagccagaaaacgtctggaagaaatagaaagtggaaaaatcacactgcatatttcttttgattgaggtaaagatataaataagttatgagaggatggaacgattatggaaatgaatatggcaaaatttagcgagaaactgcacgaacttgtagagatgggcaaaaagaagaaaaatgtgctggaatacaaagaaattaatgaagtgttaaaagatatggaattagattccgatgcaatggataaactctacgaatatcttgaagcttatggaattgatgtgctgcgtattccggaaggagattccgatgatacatttcttttgagcgatgatgatgaagtaaacttaagtgaagaagacgaagtggatatggaaaatatcgacttgtctgttccggaaggtgtcagcattgaagaccctgttcgtatgtatttaaaagaaatcggtaaagttccgcttttaagtgcagaagaggaaattgaattggcaaaaagaatggaagagggagatgaagctgcaaagaaacgtcttgcagaggcaaacttaagactggtagtcagcattgcaaaacgttatgtaggacgaggcatgctgtttcttgatttgattcaggaaggaaacttaggtctgattaaagcggttgaaaagtttgattatcgtaagggctataaattctctacttatgcaacctggtggattcgtcaggcaattacaagagcaattgcagaccaggcacgtaccatccgtattccggttcatatggttgaaaccatcaataagctgattcgtgtttcacgtcagcttcttcaggaactgggaagagaaccacagccagaagaaattgcagaaagaatggatatgtccgttgaccgtgtccgtgaaattttaaaaatttctcaggagccggtatctcttgaaacaccaatcggtgaggaggaagacagtcaccttggagattttattcaggatgataatgttccggtaccggccgatgctgctgcgtttacactgttaaaagagcagttagtagaggttttaagcacattgacagatagagaacagaaagttctgcgcctgcgttttggtctggatgatggaagagcaagaactcttgaagaagttggaaaagagttcagcgtaaccagagagcgtatccgtcagattgaagcaaaagcacttagaaaactgcgccatccaagcagaagccgtaagttaaaagattatctggattaagaacgggtagtaagaaagagagcgtaaagatgcagatttcaaaaagattagaagcagttgcttcttttgtagaacagggcagtgtgattgctgacgtaggctgtgaccatggatatattccgatttatctgtatcagaaaggcatgatacccaaagccattgccatggatgtgaataaaggaccgcttgagcgggccgagattcatattcgtgaatacgggctgggggaatacataacgacccgtctttccgatggcgtccgtgcattaaaaccgaatgaagcagatgccgtagtcattgccggaatgggtggggcattaatggaaaaaatcatagaagagggagaggagacattaaaaagtgtctcctatctcattttgcagccacagtctgaactggcacatttccgccggtttcttcaccaaaaaggatattgtatcgagcaggaaaaaatggtcttggaagatggcaaatattatccaatgatgaaagcgagaaaaggcagagagtcttatgtgcgggagatagattaccgttttggaaagggactcttagaagaaaaaaatcaagtgctctatcagtttttattgaaagaacaaaagtctttggaaacggtgaaagcacgcttagagtcagcaaatacaaagaccgcaaaggcacgccaaaaagaaatcgaaatagatttaaattatgcaaaagaggcattaaaagaatatgaagtgtaaagagataatcgagtcattggaacaaaaatatgcaccggattttgctgaaagctgggataatgtagggcttttagtcggagacaaagagaaagaagtgcataaaatttttcttgcgttagatgtgacagatgaatcattagagatggctataaaagaacaggcagacatgataattacgcatcatccgctgattttttcggcgatgaaaaaagtaacaacagataattttatcggcagaagaatcataaaaatgattcagcatgacataagttattatgcgatgcatacaaattttgatatcctcggaatggcagacttatcagcggattttctgaacttaaaagacagggaaatccttgaagtgacctatagtgatgcaaataggacagaaggtcttggcagagtgggaaatctggcacagaaaatgagtctgaaagagtgtgcagattttgtaaaaacacagttaaaattgccgtctgtgacagtttatggagatttggaaaaagaagtgcagaaagtggcagtttgtaccggttcaggaaagagcctgataaaagaagtgctgaaacatcaggcagatgtctatgtaaccggagatgcggattatcattttgcaattgatgcagtagcgcaggatgtatgtattattgatgccggacattatggtacagagtatatttttatggactatatggaaaaagagcttcaggcacttggaggagaactggaaataaagaaaatgcaggtggttcatccttttaaggtgctgtagttatagttagaaaaagcgttctgataggacttaacaggaggcggacattatggagaaaaagaccgttacagtaaaaattcttggaaagacaagagagtatccgatggggattacttatgcagagattgtaaaagagtatgaaggtgcgacaaaatatccgattgtgcttgtgatgaaagatggaaagttacgggaactgcataagaggctcaaacaggatggaacgctggaatttatcacaacagcagatgagattggtcataagacctataagcgcagtgcaattttactgttattaaaggcactgtataatgtagcagggcatgataagattaaaaaagcagttatccattatgcagtcagttcgggatattatgtgactgtggatggcgatgttgcaattactgaagactttcttttgaaagtaaaagagtatatgctggaactggtagaaaagaaaattccggtaatgaaacgcagtgttggaactgacgaggcgatttccctgtttcataaacataaaatgtatgataaagaaaatctgttccgttaccgcagggtttcaagagtaaatatttacagcattgaggaatttgaagattatttctatggatttatggttcatcataccggttatatcaaatattttgatttatatccttatgatgatggatttgtgcttcagcttccggaaagaaaagaccctgaaatcgtaccggcgtttgaacctcaccagaagattttccaggtgcagaaagaagcaaatatctggggcaaaatgatgcgcacagagaccgttggtgatttaaataatcagattactcatcagggggcaaatgaattgattctgattgcagaagccttgcaggaaggaaagattgcgaaaattgcagaccagattgtagaggcaggtcataaaaaatttattatgatagccgggccatcctcttccggaaaaacaacattttctcatcgtttgtcgattcagttatcggcacatggactaaagcctcatccgattgccgtagataattattttgttaatcgggaacataccccgcttgatgaagagggaaattataattttgaatgtttagaggcaattgatgtcaaacagtttaataatgacatgaatgcgctgcttcgtggagaagaagtagaaattccaacttataattttaaaaccggaaaacgggaatacaagggaaatttcctgaaattagaagagtcggatattctggtcatcgaaggaatccactgcttaaacgataagttaagtgagacccttccaaaagaaaataaatttaaaatctatgtcagtgcgctgacccagttaaatgtagatgaacacaaccggattccgacaaccgacggtcgtttaatccgcagaatagtaagagatgcacgaaccagaggaacttccgcaaaagataccattgccatgtggaactcggtacgaagaggagaagaggcaaatatctttccatatcaggaaagtgccgatgtgatgtttaactctgctttgatttatgaacttgcagtgttaaagatttatgcggaaccgcttttatttggaatttcaccggaagagccagagtatcatgaagcaaaacgtctgctgaaattctttgattattttgtgggaatgccgggtgaggcagttccgacgaactctctgcttcgggaatttattggtggaggatgctttgacgtctaaaaaatacctgaaaaaagagtttacaaaataaaaacagtgtgttaaaatggcgtttgtgtccagtaagatgaataatcgcggctggcaggaccgaaaggggtcaggtgaggaaagtccgggcttcatagggcaggatgccggataacatccggtggaggcgactctaaggacagtgcaacagaaatataccgccggcttatgccggtaagggtggaagggcagtgtaagagactaccgcctttttggtaacagagagggcatatgtaaaccccatccgaagcaagaccgaataaaaagcaatgtggctgcccgtcacgcttttaggttggtcgcttgagtctgttggcaacagcagaactagatagatgattattcacgacataacccggcttacagttttgctggatacaaaaaagaaagcatgagattacagctcgtaaccttatgctttcttttttgtttttatcttaatttttgacttgttttttactgctgtccaagcagatagtcgataaactgctgagcagttcttccggataaaccaccatgctgtaattcccaggcatttgcttttaagagcagttcgttttcatccatttcgatattgtttttctttgcaagggcaaggacgatattttggaattctttcttttccggagaaccaaaatagatagtgacaccaaaacgggaaaccagagaaagtttttcctgtacggtatcattggtatgcagttcttcatcacggtcactcttatctttaaaggtttcacgaatcagatgacggcggtttgaagttgcataaattaaaatgttatttggtttcttttcaagaccgccttcgataacggcttttaaatatttgtattcgatttcaaattcttcaaaggataagtcatccatgtagataataaatttgtaattacggtttttaatctgtgcaatgacatcgtttaagtctttaaactgatgtttataaacttcgatgatacgcagaccctggtcgtaatactgatttaagatagctttgatactggaggatttaccggttccggcatccccaaagagcagacagttatttgcacgttttccgttaataaaagcttctgtattgtcaatcagttttttctttgggatttcatatccaaccaggtcatctaactgaacatgtgcaattctggtgattgggacaatgcgtactgtatcatcactggttctgtgttcaaggcggaaggctttatgaagtccgagttttccgacaccgaaatctttatagaactgaaccatgtcgtccataaattcttctgtagaaacagattcgcttaaacggtcacttaaggtgcagattcggtcacggattcgtttgttaaacattttactgtttccgtcgatgtttttgtaatgacaaagaagcgcagcacagccggtagagaaaacagagtcgagtacttctaaatcaaagtcatagagctgtttaaaaatttcaaaatcatgttttgccagttcattgatggttccatccaccgtaccacgaatttcgcttgcagtactaaaagcattttcatgattgacaagtaaaaatgtaagataatcatgccacagattatcagaaaaaccgtaggcacctgccatttcaacaagctgattcatgcagttgtaataaagcgtgcgtttttcttctaaaagagcggcatcggacagctcttttgattcataagcgtggataatagaaaccatctggtctaagagttctccatgctcaaaattacgatataaaatacattcgtttaaatttatcattttgtgtttccttctttctaaataactaataacgctttgcaaatcttctaagtaataacattgtgctgtgagcgtcaaaagtaaattttgtcacttactgatattagtagttcccatgaacacgtaagttctgaacttcgcttcttaatcctcttaatgcatttttaacggcgctgtcacttaaatttccctcaaaatcaacaaagaagcggtactcccagttgcgtttcagaattggacgggattcaatctttgtcatatttaagccattgtagataaagtgagacaggctgttataaaggcttccgctttcatgaggaagttcatagctgacactgattttatgagcatcttttgcgtaaacttttttctttgcaacaataataaaacgggtagaattatcagagtttgtaaaaatgttttcacttaagatattcagtccaaaatactcggcagcataactgcttgagatggctgcctgtgacaaatcatgttcttcagatacttttttagccgccgcagcggtattgctccattccttctgatgccattctttgtgggcatctaaaaattcacggcactgcatcaatgcctgtggatgggaataaacagtgcggatgtctgaaagagtcgcaccgggaagtgcagttaaaacatgctgacagcggataatctgttctcctacgattacatggtcgtatttagtcagtaaatcgtaattatcctgtacaattccggcagttgaattttcaattgggagaactgcataatctgcgcggccgaatttgatttcttccattgcgtctttccaggtagcaacgtgatagttttttacatcttcaccaaagaaggttttcattgctccatagctgtacgcaccttctactccctggtagacaacggttacattttctttgttaataaaatcaatttttgtaaaatcgcttggttcttcgattccgttttcctgtaaaagctgatactgacgttttcggctgatggacataatctgctggaatagttcttccactccacagcggttaaaatcgcttcctgctttagcaccgagagtctttaatttatcctgttcacggcttttatcgaaaacaggctttcctgtttcaattttaaactgcgccacattttcacaaatcttcattcgtttttcaaaaagacggactatttcgctgtcaatcacgtcaatttcatcacgcatttttcctaaatctaacatggtacttgaatcctctctatttagttttgtagtttcgcttttcgtatgttaaaaaatctgtcttttaaagatgtatcgctttttatcatacaccgacactttaaaccacgcaagttttttatttacggaatagagaaaaaaggaaagggaaacctattataaaatggatagaaacgaaaaaagaagggagaagaagagataagaatggagaaaagacaaccatttattgtgtgtgggataacaggctggtgtctggaactgatttttaccggaattttaagtgcggtacgaaaagatttcagtttaaaaggaacttcttctttatggatgtttccaatttatggaatggctgcctgtatcggaccggtatcgaaaaaaattcggcatgtcccgatttttttgaggggatgtttttatatgactggaattttcggtgtggaactggcaagtggaagtgtgctcaagtatttcaaaatctgtccctgggattacagcagttcacaaattcaatataaaggtttaattcgggcagattatgctcctttatggtttttaaccggcctgctttttgaaaaaatactgtcagataattcttgatattaccaatgttctggtatattataatagagaataaaaatggaaaattagtatagtacacaggaggtaatgtatgagacatttaatgagtcctttggattttgacctggatgaattagacaaggtcttagatttggcaaatgacattgagaaaaatccggcaaagtatgcacatgcgtgtgatggaaagataatggcaaccttattttatgaaccgagtacacgtacaagattaagttttgaatccgcaatgcttcgcctgggtggaaaggtattaggattttccagtgcagattccagttcagcgtcaaaaggagagagtgtagcagatacaattcgtgtggtttcctgttatgctgacatctgtgcgatgcgtcatccaaaagaaggtgccccgcttgttgcatccatggcatcccagattccggttatcaatgccggagatggtggacatcagcatccaacccagacactgacagacctgcttaccattcgttccatgaaaggtcgtttggataacattactattggattatgtggtgacctgaaatttggtcgtacggttcattctttaattgaagcgctggtgcgctatgagggagttaaatttgttttgatttctccagaagaattaaaagtgccggattacattcgtgacgatgtgttaaaggcaagtggtcatgaatttgaagaagtagaacgtctcgaagaagccctccctaaattagatttactgtacatgacccgtgtacagaaagaacgtttcttcaatgaagaagattatgtgcgaatgaaagatttttatgtacttgataagacaaaaatgaaactggcgagtccggacatgcttgttcttcatcctcttccaagagtcaatgaaattgcaactgaagtagataaagacccaagagctgcgtattttaaacaggcgcagtacggtgtgtatgtcagaatggcattgattcttacattattggaggtagaagtatgttaaatgttgggcgcttaaatgaaggtgtggtattagatcatattaaagcaggaaagagcatgatgatttatcatgatttaaaattagataaaatggactgctgtgttgcaattatcaagaatgcaagaagtgaaaaaatgggacgcaaagacattattaaaatcgagtgcccgatcgacagcattgaccttgatattcttggatttattgaccatacgattactgtcaatattgtaaaagacggaagcattgtagagaaaaaagagttaacgcttccaaaagaaattcgaaatgtaattaaatgtaaaaatccacggtgtatcacttctgttgagcaggaattagatcatgtctttattcttgcagaccctgaaaaagaagtttatcgttgtcagtactgcgaagaaaaataccgtcgtaaataggagataagacaagaggtcataaaaagacagtcctgattttttgaaattaggactgccttttttagttatagagtaataaaagagagaacaaagtatggcagagagaaaaacctataaagagattgtacggaaatttttagaaaatgatgaagtagtgatagaaacccgtttggatggagaaagggcgggagaaaagaagatcctgacatcagaagaggcaaagaaagctccaaaagatggatggcatagggagactctgtttgcaaaaccaaaagcggtgcttttaggtggaggacacgtttcgcttgcgattgcacaattattaaagatggtagagtttcgtgtaattgtggtagatgagagagaagaatttgcaaataaggaacgcttttgctgtgcagatgaagtgtactgtatgggatttcaggaattccttgatacaaaagattttggagaacatgcctattatattattgtgacgagaggtcacaaagatgattatacctgcttaagtggtctgcttagaagagaaaagacgtatatcggaatgattggcagcaggaaaaaagttgcaatttcttttgataaattaagagcagaaggatatttagaagaagagattgcacaggtgcatgcaccaatcgggcttgcaatcggggcgcagactccggcagagattgcagtcagtattgcagctgaaattattcaaaagaaaaatgaatcaccagagattatcaatacgcttgaagaagaaattttgaagggcttagaagatgaaaaatcaaaggttttagttacggtaatcgaaaagaaaggttcttctccaagaggagagggaacaaaaatgattgtgcgggaagatgggaaaatttatggtacaatcggaggtggtgcagtggaacatgaggcaattgaagaggcaaaaaattttgatgccgaaaatggatttttaatcaaagactatgacttgtcgaatgcaaaagcagctacccttggaatggtttgcggagggaaggtaaaagttatgtttgaacgtctgtaaaatcaagggtagaaagattggtaagtgaaattaaaaacaggaggaaaagaacatggaacaggatatcaaaaaacaaattgtcggaatacttgaaaaagactgccgtttaagtgaagaagaaattgcagtgatgcttggaaaagagacaaaagaagtggaactggcaataaaagaacttgaaaaagaggggattttatgcgggtatcatgccctggtaaactgggataaagtagatgatgataccgtaactgcgttaatcgaattaaaagtaacaccgcagggcggagacggctttaataaaatcgcagaacagatttatcagtatccgcaggtagaaacgctgtatttaatgtcaggagcatatgatttccttgttatggtaagagggaaaagtatcaaagatatttcgctgttcgtgtctgaaaatctggcttctatcgaagaagtacaaagcacagcgacttactttactttgacaaaatataaagaacagggtgtgaatctgacaagaaaaaaacaggatggaagaatggtgattactttatgagagaatttgtaacagaaaaagtaaagcagattaagccatccggaattcgaaaatttttcgatgtagtcagtgaaatgccggatgcaatttctcttggagtgggcgagccggattttgatactccatggcacattcgtgatgcaggaattaagtcattaaaagcaggaaaaaccttttatacttcaaatgcaggattgatggagcttcgagaagaaatctgccgttataccgaagaaaaaatgcatgtttcttatgacccgaaatcggaagtgtttatcagtgtgggcggaagtgaggcaattgatattgcatttcgggcgacacttgatatcggagatgaagtgattattccggaaccggcttttgtttcttatgtgccgtgtgcccggcttgcaggggctgttccggttgcaattccattaaaagcagagaatgaatttcgtctgacaccggaagaattagaggctgcaattactccaaaatcaaagattttactgttatcttatccgaataatccaacaggagcaattatggaaaaggcagatttagaagccctgtgtccgattattgaaaaatatgacttattggttgtgtcggatgaaatttacagtgagttaagttataaatctgcacacgtaagcattgcgtcacttccgggaatgagagagagaaccatcgtgattaatggattttcaaaagcatttgccatgaccggatggcgtcttggctatgcgcttgcacctgcgcctattatgaagcagatgataaagctgcatcagtttgcgattatgtctgcaccgacgactagtcaatatgcggccatcagtgccttaaaaaatggcaatccggatgtgattgagatgagaatggcttatgaccagagacgacgtttcttaatgcataccttaaaacggcttgaaattccgtgttttgagccttacggtgcattttatatcttcccggatatctcaaaatttggtatgacatcggaagaatttgcaacaaaactcttacaggaagaaaaagtagcggttgttccgggctgtgcattcggagcatgtggagagggatttgtccgtatttcgtatgcgtattcgattgaagaattaaaggcagcatttgaaagaattgagaaattcatcgaaaaaatacgataaaaaaagaaaaaaggctggacattttagtgcgtaaaagctattattaattataattttacagcaataaatagcgttgaggaggatacaaacgaaaatgaagaaagtagtaaaattcggcggaagctctttagcaagcgcagaacagtttaaaaaagtgggtgatatcatccgtgctgacgaaacaagaagatttgttgtaccgtctgcaccgggaaaaagaaattcaaatgatacaaaagtaaccgatttactttataaatgttaccgtgcagcagaaaaaggtcacactgattttgataaagtattaacggaaattaaagcacgttatcaggaaattatcgatggacttggcttaggtctttctttagaagaagattttaatatcatcgaagaaaaatttaaaaatcatgcaggtgaagagtatgcagcatcaagaggagaatacttaaacggaaaaatcatggcagattatttaggctatgaatttgtagactctgcaaaaattatccgttttgacggagaaggtcagtttgatatggaaatgacaaaccgtctgacccgagaatatttaaaggataaagaaaatgcagtaattccgggattctatggagcaatggaagatggaacagtaaaaacattttcaagaggtggttccgatattaccggttctatcgtagcaggtgcactcgatgcagatttatatgaaaactggacagatgtatccggtttccttgtaacagacccgagaattattgagaatccaaaatctattgataccattacctatcgtgaactgcgcgaattgtcttacatgggtgcgactgtactgcatgaagatgcaatctttcctgtaagaaaagcagggattccgattaatatccgaaatacaaacagaccggaagatgcaggtactatgattgtagaagatacctgtaaaaaaccggcttataccatcacaggtattgccggtaagaaaggattctgttctttatttatcgaaaaatccatgatgaactctgaaattggatttggcagaaaagtacttcaggttctggagaaagaaggaatttcttttgaacatctgccatccggtattgatacaatgaccctgtttattcatcaggatgagtttgcagaaaaagaacagcaggtaatttccggaattcatcgtgcagtcaatccggactttatggaattagaatctgacctggcattaatcgcagttgtaggacgcggtatgcgttcaaacagaggaacagcagcaagaatctttgcggcactggctcatgccaatgtaaacgtaaaaatgattgatcagggttccagtgagttaaatgtcatcatcggtgtaagaaatgaagattttgaggtcgctgtaaaagcaatttacgatatttttgtaacaactcagctgtaatcataataatcataatgagaaggaaaaagtacattcgattttttggatgtactttttttgttgacaaaatctaaaatatcacgtatactacaagtgtactaagacagatagtacactaaatacacacggacagcatagaaaggaagtgaaacttcaaatggtcgtaattgattatcaaaatcgaaaaccgatttatgaacagattgtagaacgatttcagatgctgattgtaaaaggaattttagagccggactcgcagatgccatcggtacgtgcgcttgcgacagaactttcgattaatccaaatacgatacagaaagcttatgccgtactggaacaggaggggtatatctatccgataaaaggaaggggaaattttgtttcgggaaatcaggcattagtcaaacaaaaaaaagaagattttcttttaaaactgcatggggtattaaaagaaggaaaggaaatcggagtgaccggtgcacaatgtctggaatgtgtgaattccgtatttaaggagggagaacatgattaatacaacacagctttcaaaacagtttggagatttaaaagccgtagataaaattagtctccaaattgtggataacagtattttcggacttgcgggaacaaacggagctggaaaaagtaccttccttcgtatgcttgcaggggtgttaaagcaggatgaaggagagattgaaatcgatggagaagcagtctgggaaaatgaaaagataaaaggtgaaattttctttttgccggataatgcttattttccgccaaatgtgacaccacagcagatggcaggttactatagtatttattacagtaaatttaataaaaaacggtttcaggagttatgcgataaattagagttagataccaaacgaaaaatcaatacattttcaaaaggaatgaagcgtcaggtgtcgatgctgcttggaatctgtgcaggaacaaaatacttgttttgtgatgaaacatttgatgggttagaccccgtgatgcgtcaggcagcaaaaagtattcttgcatacgaggtgacggaacgtccttttacaccaattattgcatctcataatttaagggaattagaagatatctgcgaccatgtaggattattacataaaggcggagttttgctttcaagagaactggaggatatgaaaatgcatatccataaagtgcagtgcgtgattcaaaatccgcttttggaagaagagttgcttcgggaacttgatgttgtacagtctgaaaagcgtttatctttattgaccttaattgtaagaggtgaaaaagacaagataatggaaacggtagaaagtaaatttccgctgtttgcagagatgataccgcttacactggaagaaatctttatcagcgaaacggaggtggcaggatatgacatcaaaaaactgtttttctaaaatgctagtacgagatttaaaagagagaggcgtctggctgattagttccattattttatttctcctgatttatccggttcagattttaatgagtctggatgcaattgcttcttatatgaaaggggaagaagaatttcaaagcagaattacagaacagttttcaagtctgattagttttggaaatgggatcatgtatgttgcaatcgtaatcatggcgtttttactggcaatgtcaggattctggtacgtatattcgggagtaaaaacagatttttatcacagtcttccgataaaaagagaaaaattgtttttagaacgctatgttactggaattttgatttttatagttccgtatttcattagtctgatacttggatatggtgccggaatcatgaaaggagcagagacttctggaattttaagtttatgtgcaaaagggtttgtcacaaatgttgtgttgtttttgcttttttataatcttgcagttttaggcgttctgcttaccggaaatttatttaccggagttttggcgtatggggcatttttaagttacggagttttgttagagagtacaattggtctaacaaaagtagctttttttacaacttatatagataactcaagattgagtcaggtttttgaagggaaatttggaaagttaagtccactttatgtgtttgatatgattctgtcaaataataagatttcgatgaaggatgtcagtgtagtctttggaatctcagtgctgtttttggtaatctgcatgtttgtttataaaattcgtccgacagaagcttatcataaatcaattgcttttaagaagttacagccaattataaaggttgcagttgtcattccgttttcagcatgtgtaggcattttatcaagtgaaattgtcggacgaaattttatctggtatgtgggaggtttgcttgttactgctgtgctcttatcctttgcaatggaatttttatattatttagatatcagagaatgtattcgtccaaaaatttctaccggattaattctgggaatgctggtgataatggcggtgacattaaagttggatttaataggatttgatacctatttaccaaaagaatcaagagtaaaaaacatgtccatttatattgatggattaaacagctgttatgattatccggaaggcgccggagagatgtacggaacagttccttttttacagaataccaagatagaagagtttgatgccatttatcagcttgcgaaaaaagcagttgcaattcaaaaagcagataaggtaactgcagattctgaaataacagattccgaaataacagattccgaagaactttatttttctgtttgctatgaaatgaaaaatggaaaagaggtttaccgcggatactgcattccgaaggatgaagaaaatctgaaattaattgcagatatttatgataattgggagtttaaacgacaggttcttccggtagaatatgtaaaagaagaaaagatttcttctcttgaaattgcggatctccagtcatctcatgattccgaactctctaaagagacaataaaaagtctgtttaaaacctgtaaaaatgaatgggagtctgcaacatatgagcagttgagtaatgataaagtacttggatttttacgattttatctggattatgacagagaaaacggtgattatgataccggatccagatgtgtaagtgttccggtttactcaagttttcagcagacgagaaaactcttagaacaaaacggctgtaaaatgatgacatttgaagattatgataaggtagaaagaattgagataagtcaatatgacgataaaacaggagaccttggaggtatcctaaatgtcaccgatgaaaatcagattcgggaaatacttgaggctctttacataacagataacagtgaaatatttgatataagcacgataaactatcagattgaagttcagattgactggaaatcggaggtctttaataatacggatggtttttgcagctgttatttccgcaccgatgaagtaccggaatttgtaacaaaagaattagaagaataaataataacacctgtgccaattaatgcgctttggcatgggtgtttttcgttcattgacaatcggataaaaagcagagtaaaataagtgcatcagaataaacgagaaacaaggaggaaattatgagacgaaagttatcctttgatgatgaaaaggatttggttttgcttggcaaagcactttcttctgaaatcagaataaaaattttaaaactgcttgacaccaaaccttactgtgtcaatgaaatcgcagagcttttaaagattccggcatcttcagcagccttaaatgtaaaagtattagaggaggcacaactgatacggacggagttaaaacccggagtcagaggttctatgaagttatgcttaagacaaaatgatgaactgcttttgcttctaagaaaaggagaaaagaaaaagaaagaggaagtcatttccatgccggttggaaattatgtggattataaagttgcacccacctgtggaattgtcaatacagaggactatattgacggggaggatgaaccaagatgtttttataatccactgcgtacgacagcaaagctggtctggtttgcaaaggggtatctggaatatcgttttccaaatgccggaatccagaatgggagggtcagacgactggaattatctgcggaactttgttcagaagcaccggattataacatggaatggccatccgatattaccctttggattaatcagagggaagcaggaacgtggacgtgtccaagtgattttggaggacgcagaggaaaattaaatccagactggtgggaagacaagaatacccagtatggaaagttaaaagtctggacattggaggagaacggaacatatctcgacggaaaaaaagtaaatgatgtttcagtaacagattattgtctggcagatggtccgtttatctctgtgcggattggagtaaaagaggatgcaaagcatcagggcggtgtgaatttgtttggaaattcatttggagattatccacaggacattgtgatgcggattctatatgagtaaataaaacttgaaaaaatcaagttttgtggtataataaaaacaataataatgttttaaaacataaattatattttgcaaaatttgggaaggggaacgacatgttaaacgaaagtatcaaaaaactggttacttatggaatggaaaccggactcgtaccggaatgtgaaagaaactacacgattaatctgttgctggatttatttcatcaggatgattatgaagagccgcaggaagaatatacaaatgtagatttggaatcaaccttaaaagaactgcttgatgaagcggttacaagaggcattattgaggacagcatcggttaccgcgatttatttgataccaagattatgaactgtctgatgccacgtccggcacaggtacagcagaaattcaaagaagagtatgcaaaatcaccggaatgtgcgactgcttatttttataaattaagtcaggacagtgattacattcgtcgttaccgtattaaaaaagatagaaaatggacggcagaaagtccttatggcacaattgatattaccattaacctttcgaaaccggaaaaagacccgaaagcaattgcggcagctaaaaatgcaaaacagagcagttatccaaaatgtcagctttgtatggaaaacgaaggttatgcaggtcgtttaaatcatccggcgagagaaaatcacagaattattccgattacaattaatgacagcaagtggggattccagtattctccttatgtttactataatgaacactgtatcgtatttaatggacagcatgtgccgatgaagattgagagggctgcatttgtaaaattatttgattttgtaaaacagttcccacattatttccttggttctaatgcagatttaccaatcgtaggtggttcaattttaagccatgaccattttcagggtggtcattacacctttgcaatggcaaaagcgccgatcgaagagcacgttaccattccgggatatgaagatgtggaagccggaatcgtaaaatggccgctttctgttttgagaattcgtcacaaggatgagaaacgcctgattgatttggcgacccatgtattagaagtgtggagaggatatacagatgagtcagcttttatctttgcagaaacagagggagaaccgcataatacgattactccgattgcaagaaaaaaaggcgatgtatatgagcttgatttaactttaagaaataatatcacgaccaaagagcatccgcttggtgtctatcatccacatgctcagtatcatcacattaaaaaagaaaatatcggtctgattgaggttatgggacttgcagtacttccggcaagattgaaagacgaattagagctgcttgctgagtatctggttgagaaaaaagacccggctgaaaatgaaagcctgaaaaaacatgcagactgggtaaaggaatttttaccgaaatacgaagaaattaccaaagaaaatgtaatgggaatcctggaagaagaagtcggacaggtatttgtaaaagtcttagaggacgcaggtgtttataaatgtacgaaagagggaagagacgcctttaaacgttttatttccgtattataaaagcagaatagaataagtgaaaaagggaattgtcatattaaaaatggcagttccttttttatatccgttcttaccttgtttgttctcttttaagtgtgctataatgagtgaaaagaaaaagaaagaggtcgataaaatacagatgaaaaaaagagtagaagattcacagaccgagcagacgtatctgatgcgtcccatttatttaaatgaatatggaaatctttttggtggtcagctgatggaatggatcgatgagatcgccagtattgtagcaatgcgccacagtgaggcagacattacgaccgcctgcattgataatttgaattttaaagagggtgcaaccgtaaatgatgtcattgtgcttcgcggaaagattacttatgtaggaagaacttccatggaagtgcgggttgatacttatgtggaaagccgtcatgaaatccgcaaggttatcaaccgtgcttacgtggttatggtcgcggtggatgagcatcaccatccgattccggttccgggtctgattgtagaatcagaatcggaaaaagcagagtgggaaggcggcgaaaaacgctacgcactcagaaaagaaagaagaagagagggctattagatgagcgaaaaaatcctgctgatagacgggcacagtattttaaatcgggcgttttacggacttccggagcttacaaatgcagaaggacttcatacaaatgctatttatggctttttaaatattttatttcggattgtagaagaagaaaaaccggattatttaacggtggcatttgatttgcatgcaccgacctttcgccataagatgtatgcagattataagggaaccagaaagggcatgcctcaggagctaagagagcaggttccggttatgaaagatgtcttaatggcgatggggattacgattgtcgcaaaggaaggctacgaggcagatgacctgcttggaacattggcaaaaaagagcgaagcaaggggaatggatgtaacggtgctttccggagaccgtgacttgcttcagcttgcaagtaagcatatctgtatccgaattccaaagaccagatttggaaaaactacgattgaggattattttgaagaaaatgtcaaagaaaaatatcagctgacaccggcacagattattgaattaaaggcgctgatgggtgattcttccgataatattccggggcttccgggtgtgggagaaaagactgcgacaaagattttgctggaatacggcacggtggaaaatgcatggaaacatgtcgaagaattaaagccgaataaagcgaaaaatgcgttcttagaacattatgatatggcaattttaagtaaaaaacttgcgactatcaatattgacagtccgattgaatatgactgggaaagtgcgagaatcggagaattttacacaaaagaagcttatgaatattttaaagaactggaatttaaaaatttcttatcccgttttgaagaaggggcagaaccggcaaaaattgcagtttcttttcaaaacgtaaccgattttacagaggcagatgcgctgtttgaaaaactggtgaaagaaccggaacttggaattgaagttttaagagaagcacatcagtttttggggcttggacttgcatggaataataaagaaaaagaagaagtggaaacagtctgcatttttccacagggatttttaacagaaagttatctgatggaccaggtgcagaagctttgtgaaaaagtagaaaggatagatgctcttgatgtaaaagagacaatttcagaaatttcaaaagtttcgcataagaaggtgtttgatgccggaattgctgcatatctgttaaatccactgaaatcttcttacacctatgatgatattgcaaaagagtacttaggagaaatgcttccggcaaaagaagacttgattggaaaactttcctatacaaaggcaatgagtgaaaaagaagcaaaagagaaagaagtcgcaaaaagtatctgttatatggcatatacagcattaagaagccggaaggcgctgatggaagcacttgaaaacaataatatgaaagcgctttttgaggacgtagaactgccgctgttatttacactttctaatatggaaaaagagggaatccgcgtcaatgcagaagccttaaatgaatatggaagtcagcttgaggtaaaaatcaaagcattagaaagccagatttatgaagaggcaggagaagagtttaacatcaattctccaaaacagcttggtgtaattttatttgaaaaattacagcttccgggtgggaaaaagacgaagaccggatactcaaccgcagcagatgttctggagaaacttgcaccggaacataaactggtagcagatatcctggaatatcgtcagcttgcaaaattaaaatccacttatgcagacggacttgccggatttatcggggaagacggcagaattcattctacgtttaatcagacgattacggcaaccggaagaatcagcagtacagagccgaatcttcagaatattccgatccgtatggaactgggacgcctgattcgtaaagtctttattccagaagatggatttgtatttgtggatgcggattattcccagattgaacttcgtgtgcttgcgcatttatcaggggatgaaaatctgattgaagcctataaagaagcgcaggatattcaccgaatgacggcttctcaggtctttcatgttccgtttgaagaggtgacggatttacagagaagaaatgcaaaagcggtgaactttggaattgtatatggaattagttcgtttggattgtcacaggatttaagtattacaagaaaagaagcagcggaatatattgaaaattattttgctacttatccaaagattaaaggcttcttagatggactcgtaacagaggcaaaagaacagggatatgtggaaacaatgtttcaaagacgtcgtccggtgccggaaatccgttccggaaactttatgcagagatcctttggggaacgtgtagcgatgaattctccgattcagggaacggcagcggatatcatcaagattgcaatgattcgtgtggaacaggcattaaaagagcagaatctggagtcacgtctgattttacaggtacacgatgaactgttgatcgaagccaaagaagacgaggtcgaggcagtaaaggcaattttagagcgggaaatgaaaggtgcggcaaacctggcggttccgcttgaaattgatatgcataccggaacaaactggtatgaggcaaaataaaaacctggaaaaaatacaagatgaatcataacgtacgaaaggggaaagtggtatgagagtaataggggtaaccggtggagttggttccggaaaaagtgcggttttaaattatattgaagcacattttgatgcaagaattataaaggcagatgatgtcgggcatctgttgatgatgccggggcaagtctgctatgaaccggtcattcaactgtttggtgagtggattgtcaaagaggatggttcattagatcgtgaaacgatttcaaagattgtatttgagaaaaaagaaattcttgaaaagttaaatgcaatcattcatccggcggtaaaaaaatatattttaagagagattgaacgttccaaaaaagaaaaaaccgaatttttctttatcgaagcagctcttttaattgaagaaaaatatgatgaaatctgtgatgaattgtggtatatttattgcgaaaaagaagtccgcatggaacgtctgcgccataatcgtgggtattccgataaaaagattgagcagatgttaaagaaccagctctcggatgaggagtttgagtccaaatgcgacttccagctttataatagtgaagatgtggcacatacctatcttcagattgaaaggaaaatgaggacttattatgaatctatgtagcattgccagtggaagcagtggaaactgcatctatgtaggcagtgataaaaccagtgttcttgtagacgcaggaatcagcggaaaacgaattgagcagggattaaacagtattgagcgtaccacaaaagactgcgatgcaattttaatcactcatgaacattctgaccatgtcaaaggacttggagtgcttgcaagaaaataccacattccaatttattgcaccaaaggtacaatggaagaattaaaacaaatgtcaatgcttggaaagatgccggagggactctatcgtccgattctggcagaagaaacattttcaattggagatttatccattctgccatttgaaatttcacatgatgcggcagaaccggtaggctatcgggtttctcatggagaaaaatcggtagggattgcaacggatatgggagtctatgacgaaaaaatcgttgaaaaccttcagggactcgatgctctgcttttagaggcaaaccatgatgtgaggatgcttcaggtcggcgcttatccgtattctttaaagcagagaattttaggggaaaaaggacatttatccaatgaatcggcgggaaggctgctctgccgtctgcttcatgataaaatgaaacagattatgcttggacatttaagccgggaaaataattatgagatacttgcttatgagacggtgtgtgcagaagtgacgatgggagaaaacccatggaaatcttcggatttcaaaatatctgttgcgcacagagaccgtgcatctgaactgataaccgtatagaaaaattttagatagaaaacaggttgtaaaatgcggcaaaatgcagtaagataaaacataaaaaatacgcttggaatttttgagagtgaaaaaggagaacatttaaaatgaaaaaaacgattatcaccgtagtaggacaggacacagtgggaattattgcaaaggtatgtacttatcttgcagaaaataaaattaacattcttgatatttcacagacaatcatcgatggctattttaacatgatgatgattacagatacttcaaagtctgagaagaaactggataagatttctacagatctgacagaattaggcgaacaaatcggtgttgcaatccatgcacagcatgaagacatttttaacaaaatgcatcgtatctagttaaattaagcagttgctggattgacgctgaatatttgcggaactggtagttctgagtttagttctaatttctgaaaggataaaatacacatgattaacatatttgaagtaaatgaaacgaataaaatgattgagcaggaaaacctggatgtgcgtaccattacaatgggaatcagcctcttagactgtatcgattctgatttacagcaggtaaaccgcaaggtttatgaaaaaattacaacactggcaaaaaatctggtagaaaccggagaagagatttcaaaggaatatggaattcctgttgtaaataaacgaatttccgtgaccccgattgcactgattggcggtgcggcatgtaaagcaccggaagactttgtgacactggctcagacattggataaagccgcaaaaaaagttggggtaaactttatcggtggttattctgcaaccgtttcaaaaggaatgacaaaagcagatgaaatgctgattcgttctattccggaagcattggctacaacagagagagtctgcagttctgttaatcttggctctacaaaaacaggtatcaatatggatgctgtaaaattaatgggtgaaattgtgcttgccactgcaaatgcaacaaaagaacaggattctcttggctgcgcaaagctggttgtattttgtaatgcaccggatgataatccatttatggcaggtgcgttccatggagtaacagaagccgatgcaattatcaatgtcggagtttccggtccgggagttgtaaaaactgctcttgaaaaagtacgtggaaaagattttgaagtattatgcgaaaccattaagaaaacagcatttaaagtaacacgtgttggacagctggttgcaaaagaagcttccaaacgtcttggtattccgtttggtatcgtagacttatcgcttgctccgacaccggctattggtgatagcgtagcaggaatcttagaagaaatcggtctggaatatgcaggtgcacctggaacaacagcagcacttgcactcttaaatgatcaggtcaaaaaaggcggagttatggcatcttcttacgttggtggcttaagtggtgcatttattccggtcagtgaagaccagggaatgattgatgcggtaaaagcaaatgcactgaccattgaaaaattagaggcaatgacctgtgtctgctctgtaggtcttgacatgattgcaattcctggagatacaaaggcaactaccatttccggtatcattgcagatgaatgtgcaatcggtatggtaaaccagaaaacaacagccgttcgtgtgattccggtcatcggaaaagacgtaggcgaaacagtagaatttggcggtctgttgggatatgcaccgattatgccggtgaatccatattcttgtgatgcatttgtaaatcgtggcggaagaattccagctccaattcacagctttaaaaactaaaaaagccaaaattgcagatgacagacaaagcaggaagaaaaaaatgtaccatagattttggcttgacaaaagagttagattatgctaactttggagtagaaacagaaacaaagacagctgaaaaagaaagaagatgttgatatgaatataggtacatttgttgttttagttattgtagcatgcattgttggtctggcagcacgaaaggtctggaaagataaaaaatccggaaagagctgcagtagttgcggaggcagttgtggtggatgcagcggatgccatccggcaccatcaaagaaaaaataaaaaacaataaagatagaaatacgatgaatcattataaataatggttcatcgtatttttttgtttcatcaaaattggggatatggtagaataaagcataaacttaagtgaggcagaagaaaaccctaaggtaaaaaagaaaggaagcgaagcatgacggattatgtaagtttacaagatgtaacaaaaacctaccgcatgggtgagattacaataaaggcagcagatggaatcagttttgatgtacaaaaaggcgagtttgtcattgtagtcggaccaagtggtgcgggaaagacaaccgttttaaatattcttggaggcatggatgttgcaacttccggaaaagtatttgtagacggagcggagattacaaaatatcgggggaaaaaactgattcagtatcgaagagaagagattggatttgtctttcagttttataatttaatgcagaatctgacagcacttgaaaatgtggaacttgcaatgcagatttgtaaatatccgcttgatgccaaaaaagtattagaagaagtaggcttaaaagaacgaatgaacaattttcccgcacagctttccggaggagagcaacaaagggtggcgattgcacgtgcacttgcgaaaaatccaaaattactgctgtgtgatgagccgacaggcgctcttgattatgtaacaggaaaggcaattttgaaattattgcaggatacctgtcgggaaaaagaaatgacggtaattgtcattacccataactcggctcttgcaccgatggcagaccgtgtgattaagattcggaatggaaaagtggcagaaaccgtattaaatgagaaaccgatgccggtagaagagattgaatggtaggaagaaaggaaaaagatgaaagcattttggaaggatttctttcgggaaatcagtaaaaataaaggtcgttttctatccgtatttttcatcgttttgttaggttcagcatttttttccggaatccgctcggcagaaggtgatatgaaagtatcagcagatcgatattatgacgatgtcgattatatggatttgaaaatacttggaacaatgggtctgacggatgaggatttaaaggatatccaaaatacagagagagtaaaaaatgtaaccggaggacataccttagaagtcttacataaagtaggagaaaaagaacaggttgtcaaattaattgcgctgacggacaaagtaaatgagccacaaatcaaagaaggaaggatgccggaaaattcagacgaaattttagtggacgagagttttttgagttattcagactgtaaaatcggagataaagtgacatttgaatccggaacagacgaggcagttacggattctctgacaggagatacctttacaattgtcggaactgcgacactgccgtattatatggatttaaacaggggaacaggttcaattggaacaggaagtattaacagttttgcactcttagagccggaagtatttacttcagatgtttacacagaactttatgtacagatagatggagcgaaagagtcagccagctatagtgacgaatatgataaaacagttaagaaagtacaaaagaaaatagaagcgttagaagactcagcctgtgacagacgatatcagaccatccagaaagaaggacaacaggaaattgcggatgccaaagagcagattcaggacgcagaagagaaacttgcggatgcaaaacaaaaactggatgatggagaagttcagctttccgatgcaagaaccacgatttccaaaaaagagcaggaactaaacgatggagagagcgagttaaaagcaaaagaagcagaactggaatccggcaagcagaccttagttcaaaaaacaaaagaattagaaagtgcaaagacacagataacggaaaagaccaaagagttagaaagtggaaaacaggctttagaatccgggaaaaaagaacttgaagcaaataaaatacagcttgcacaaaaagagcaggaattaaatgccggaaagacacagcttgaagaagcaaaaatacagcttcagacaaagataaaggagtttgaaacaggaaagagccagtatgaggagaaaaaatctgcttatgaagcgcaaaaaagtcagatagaaacagcaaaaacacagctggaagctgtgagtgcaggaattactcagatagaaaatgcgcttactgaaatgaagaatcagctggaaattttggaagagcagttagccaaaagcgagagttcagatgaaacttatgagacacttttggcacagaagaccgaactggaatcccagataacagcccaaagcgaagcactttcaacacttattgctcaaaaagaagcgttagaagcaggaatttcggcatttgaatcagcaaaaccagaggcagaagcccggctggaaaaggcaagaatacaaatcgaagaagcaggcacgcagattgaacaggcaaaggcaacgctgtcccaaaaagaagaggaattaaatgcagggcaggttcagatagattctgcgaaaaagcagttacaggaagcagaagaaaagataaaacagaatgaagccataatttcggatggagaggcacagcttgtacaggcacagaatcagataaaagagggagaaagccagattttggaagcacagaatacgcttgctgatggagaaaaacagcttaccgatgccaagcagacgcttgccaaaggacggacttcccttgaagaagcaaagagtgaattagaagcaaaggcacaggaattagaggacggaaaagcagagtatgaaaccgcaaaaaaagatgctgaaccggaaatcgccgatgcaaaacaaaaaatttcagatggagaagaagaactggcgaaattggaagttccaacctggtatgtctggggacgagataagattacttcaacagaaagttttggacaggatgctgagagaatttcaaatatcggagaatttttcccggttatcttctttttagttgcggcactggtcagcttgacaaccatgactcgtatgattgaagaacagcgccagcagataggaacattaaaggcacttggttattcagatggaaaaattgcattaaaatactttgcttatgcaatggtttctaccgtctcgggtgcacttgcaggcgtggtagtcggagaaaaaatcctgccctgggtcattatgaatgcgtatggaatgttgtatacgggacttctttattacctgacaccattaaactggcatcagggaggacttgctgttttggcaagtgcaggctgtaccggagttgcggcccttgccgcatgccagaaagagctgatgtcaaagccagctgaactgatgcgtccgcaagctccaaaaaatggaaaacgtatctttttagaacggattgatatcttatggaaacacttgaactttacacagaaatctacagtacgaaacttagtgcgctataaaaaacgattttttatgaccgtaatcggaatcggaggctgtatggggctgatattggttggattcgggcttcaggattccattactgccattgccaagaatcagtttgttaatttatttacttatgaagcaaatgtaattttagattccaacgtttcggaggctgaaaaagaagcccagcagaaagacttaaaagcttatcagggaatcgatgagatgctggaactctattgtcagaatgtagagctgcaaagtgagaaaaagacggtagatactgtgcttgaggtaccaaaaacgttagatggatttgaagatttttttgaatttcgtgaccgtgtaagcggtaaacattatgcctttccaaaagaaggagcagctataagcgaaaaaacagcagatatgcttggggtaaaagtgggagatacggtagaactaaaaaaaggagatacgatagttaaggtcaagatttccgttattgtggaaaattacgtccgccattatctgtatctgacaacagagacttataaaagtctgtttcatgagactccggattataatcagctgttgttaagatatcaggatacttcaaaagattatgaggatgcactcggagaaaaaattatgaaatacgacagtgtggcagcaatttcttttacctcggatttaatcggccagattgatgacatgctgcgctcccttgatattgtaattgtggtgctgattgtgtcagcagggttgcttgcctttgtggtattgtataatttaaacaatattaatatcacagaacggcagagagagctggcaacattgaaagtattgggattttatgatggagaagtggcatcctatgtgtatcgggaaaacattgtgctgactctgtttggaattatcgccggaatgggaatcggaaactttttgcaccattatgtgattcagacagtggaagtggatatgatgatgtttggacgaaatgtatttttcagaagttatttttacagcggactcattaccctggcatttgcattgtttgtaaatggaatgatgttttaccgactgcgaaaaattgacatgattgaatcccttaagagtgtggagtagaaaggaaatcaatatggctttagtgacaggaattattgcagaatacaatccttttcataatgggcatgcttatcagattcaaaaagcgcgggagctaaccggctgtgattttgtggtggttgtgatgagcggagattttgtacagcgtggcgcaccggcacttttcgataagtataccagaacaaagatggcacttttggggggcgcagacctggtactggaattaccggtctgggcttccagcgccagcgctgaattttttgcggcaggagcagtttctgttttagagggaatcggctgtacggattttttgtgttttggagcggaagatgagaagctctcaaagatgcagaaagcagtgaagctgcttgcagatgaaaatacagaatttcagaaacaacttcgggatgcgctaaaaacaggtctttcttttccggctgcaagaaaacaggcgctaagcggtttcttaacagaagaagagagcagtatcttagataagcctaataatattcttggaattgaatatttaaaggcattaaaagcaaagaactcttcgatagagccggtgattgtaaaaagggaagggcaggggtatcatggacaggaactttcccatggatttgcaagtgcttcggggattcgcagtgccttaaaagacgtgggagactgggaacagcatgagaaaatttctcagcttttccatgtaatgccaaaggaaattacagaaatttttatagaggcaggaaaacagaatcagatggtatgggaggatgatttttctctgctgttacaatacaatctgcttaagcagaaaaacagattacagctgactgcttacagcgatgtttcaaaagaccttgcaatgcggatttctaaaaatttaaatcaatttgagtcttatagtagttttgttcagaaattaaagacgaaagaactgacgtatacccgaatttcgagggctttgcttcacattttattagagataactcaggaagagactcgaatgtttctacacaatccttatactcgaattttaggattcaggcaggacagcaaagaagtgttaggaaaaatgaaaaaagcaaaagaaattccggtacttacgaagatttcgaattatcaaaaagagttggcaaacattcaaaaaggtctgtttgaaaaagatatctttgcgtctgatctttatgaggcagtgaccggaagaaaacaaaaaagaggattgacaaatgaacttcaacattcgccgattattctaagataaacaaggaatgtttggaaaagaatacaatttttgtgcataattttcaaatgcacacttgtaccgtttttggaaacgatgtataataaaaacaggcacgaccatctctaggtcgtaatgaattagcataacggaggaaaaattatgaacgtattagtagtaaattgcggaagttcatcattgaaattccagctcatcaactctgaaacagaggaagtagcagcaaaagggctgtgtgaacgtatcggtatcgatggaagactggtatatcagccaacaaacggagaaaaagaagtaacagaagcaccaatgccaactcatacagaagcaatcaaaatggtattagacgctctggttaatgaaaaaacaggtgtattaaagagccttgacgaagtagaagcaatcggacatcgtgtactgcatggtggagctaaaatctctgattcctgtattatcaacgatgaagtaatctctgttatcgaagagtgctgtgaccttggtcctctgcataaccctgcaaacctgatgggtatccgtgcatgtatggaactgatgccaggtaaaccaaacgtagctgtatttgatactgcattccatcagacaatgccggaaaaagcatatatgtatgcaattccgaaaaaatactatgatgaatataaagtacgtaaatatggtttccacggaacttctcatcgtttcgtatcgaaagaaacgatcaaattccttggtcttgacccggaaaattctaaagtaatcgttgctcatcttggaaacggttcttctatcagtgcagttgtaaatggaaaatgtgttgacaccagcatgggtctgacacctcttcagggtcttgtaatgggaacacgttccggtgaccttgacccggctgttcttgaattcatctgtgcaaaagaaaacattgatgtaaaagaaatggttcgtatcttaaataaagagtccggtttattaggactttctaacggactttccagtgacttccgtgacttaaacgaagctgctgaaggcggaaacgaagatgcaaaacgtgcagtagactgcttatgctacagcattatcaaatacatcggttcttatgtagctgctatgaacggtgtagatgcaatcgcatttacaggtggtatcggtgaaaatgcaattccggttcgtgaaactgttgtaaagagtctgggatatcttggaatcaaattagatgaagaagcaaaccagacaagaggagaaaataaagtaatctccacagcagattctaaagtaaaagttgcaatcgttccgacaaacgaagaacttgcaatctgtcaggaaacagcagaactggtaaagaatcagaaataatagttgacaaaaacgaattacctatgtataattgacaaggtgtgattaggagactattatgctaattgatttatcagatattttatccgtggatggaaagacgaaagaattaaaaatgccggtttccatggattcctttgaatcaaaacttggcagttttccggtagtagaaaaacagccgttagatgttgtaattacgaatacaggaaaaaaagtgcttcgaattgaagtaaaaggcaaagtgagtcttgctctgccctgcgaccgttgtcttaaagatgtggcaacggaatttgaaattgaccttgaaaaagaggttgatatgaaaacttcagaggaagacaggataaaagacttagatgaaattaattatatcacaggttgtagcctggatattgagcagttagtgcataatgagattttaatccattggcctatgagggtcctgtgtaaagaggactgcaagggaatctgcagccattgcggaaaagacttgaatgaagggccatgctcatgtgagcaggagagcccggatccacgaatggcggcaatccgtgatatatttagcaaatttaaggaggtgtaattatgtccatctgtccaaaaaataaaacttctaaagcaagaagagataaaagaagagcaaactggaaaatgactgctccgaacttagtaaaatgcagcaaatgtggtgctttaatgatgccgcacagagtgtgcaaagcttgcggaagctacaacaaaaaagaagttattgctatggatgctgaataattcatagtatgaggggctgtcgtgtttaggcacggcagccttttttcattttataaatttataaatgaattttgtaataaatttgtaataaaattgcaagtttttcttgcgattttccagaaaacaagttaatataagagagaacttgttaaaggaggagtttagtatgaataatagatggtataaaaaattattactgcttcttacggtaggatgcatgactgtttctatgaccggatgcagtgcagattctgtattagataaattattgtcagtgactgacccaaagccggataaaaagacagaggcaacgaaagaggatagcagtgataaaaaagacagtgcaggtgaaaaagaagtagaagtggcaaaaccggaatttaccacaaacttaagtggagcggtgacttatgcggtaaatgccaaagcttctgcactgacagtagaagcaactacgacggatgatggaagtattacttatcagtggtataagagccagaccgatacgaatggcggtggaactttaattgacggggcgacagaagcaagttacactccgccaaccgataccgaagggacactttattattatgttgtagcaaccagtaccattggttcttctacaaatggagcaaccagtgataccgcagaagttattgtgtcagcggatggaaccattccgtctgaaagcgaagaccaggcaggtgcaagtaaggtacttggcaaatgggtacagaataatgatggctggtggtatgataatggggatggaacttatccgagaaatgcatggaaacagattgatggaaaatggtatgcatttgatgaaaaaggttatatgagagtcggatggtttaaagatggagactcctggtattatctgttagacagcggagagatggcgaaagatacggatattgagggatatcatattggttcaaatggcaaaatggaataaaggaataaacaacagttcatcgcaggcacgctctcgctgcttgtcgctggcagtggtacgtaagcgacgaaaataccgtcgctaagtaccagccgctccaaagcacctgcttatgaatctgttgaaagcaaagagtggcagggatgaacgagatgcaaatggcagttggcatcatttgttccgatgtgctgtagtataaatctgttgaaaacaaagagtggcagggatgaacgagatgcaaatggcagttggcatcatttgttccgatgtgctgtagtatagatctgttgaaaacaggaagtggcagggatgaagtgattttgggcggtcgtaaaagagattatcttttacggccgtttctcttgccctttttttagatgtctggtaaaattaggggcatagcgtacaggaggcgatgaaatggagaaaatggagaatctgattacagtggtagtcgacgccatgggcggggataatgctccgcatgagattatcaaaggggcagtcgaggccgtaaaagaaaaacaaaacttaaaggtacttcttgtcggacaaaaagaagtggtggaaaaggaattaagcgcttatgattatccgaaggagagaatagaagttatacatgcatcagaagtgattgagactggagaaccgccggttgctgcaatcaagggaaagaaagattcttcgattgtagtcggaatgaaactggtcagaaagggagaggcagatgctttcgtttctgccggaagttccggtgcgattttggttggcggaactacaattgtaggtcgaatcaaaggaattgagcgtgcaccgcttgcaccgatgattccaacgaaaaatggcgcatcacttttgattgactgcggagcaaatgtggatgcaaggtcgtctcatcttgtgcagtttgcacgtatgggttctatttacatggaacatgttgtaggggttaaaaatccaagagtcggaattgtgaatattggtgtggaagaggaaaaaggcaatgccctggtaaaggagacatatccacttttaaaagaatgtaaagacattaactttatcggaagcatcgaagcaagagagattccatccggtgttgcagatgtaattgtaaccgaagcctttgtaggcaatgtgattttaaaattatatgagggagtcggagcgactttgatttctaaagtaaaagaaggtatgatgaccactcttcgcagtaagattggagctttgcttgtaaaaccggcattaaaaagtacattaaaaagttttgacagcagccagtacggtggagcaccgcttctcggattaagagggcttgtagtgaaatgtcacggaagttccaaagcaaacgaagtgaaaaactcgattattcagtgtatttcctttaaagaacaggacattagtgaaaagattcgggaaaatattacagtagcggtgaaaaagacagaggaggagcaataaaaaatggagttagaaaaattacagaagattatcgcagaggtattaaatgtagatgcacaggaagtgacaatggatactacattcgtagaggatttgggagcagattctttggatatattccagattatcatgggaattgaagaagaatttgatattgaaatgccaaacgaagatgtagaacatattgtgactgtaggagatgcagtagaagaaattaaaaaaattgtaggataactaaaagagtcagatgtcttcaaaagggaaaaattcggatgaagacatctgattttcagattgagaagaagaaaattcaggctgaacgcaagagagactttagataaatagaaaaaagtagaagggaagtttgttaatcgatgaagaagttattagagcttgagcagagaattggctataaatttgaaaattttgatttgctcgtaaaagcaatgacgcatagttcttatgcaaatgaacacagatatgaaaagaaagaaaataatgagcgtctggaatttttgggagatgcggttttagagctgatttccagtgattatttatttgcaaagtatccggaaactccggagggtgtactgacaaagaaacgtgcaagtatggtatgcgagccgactttagcattatgtgcaagagaaattccactgggagattatttattacttggaaaaggtgaggatgcaacaggcggaagaaaaagagattccattgtttcagatgctatggaggcattaatcggtgcaatttatctggacggtggttttgctaatgcaaaagagtttattgaccggtttattttaaacgatattgaaaacaaacagctcttttatgatagcaagactacgcttcaggaaatcgtacagggaagttatgatgatgatgtacgttatgaactggtaaaagaagaaggtccggatcacaataagagcttttatgttcatgctctgcttggaagtacggtattgggagaaggaacaggccataccaaaaaggcagcagaacagcaggctgcatattgtgcgattaaaaaacttaagagtaagggtggcctatgtatttaaaaagcattgaagtgcagggatttaagtcctttgcaaataagataacatttgaatttcacaacggaattaccggaattgtaggaccaaacggaagtggaaaaagtaatgtagcagatgctgtacgctgggtgctgggagagcagagcgcaaaacagcttcgaggcggaaacatgcaggatgttattttctcgggaacagaaacgagaaagcctcttggatttgcttatgttgcaattactctagataacagtgaccataatcttccgattgattatgaagaagtgacgattgcaagacggctttatcgttccggcgagagtgaatacctgatgaatggggtttcctgccgattaaaagatgtcaatgaattattttatgatacgggtatcggaaaagaagggtattccattatcggacagggacagattgataaaatcttaagtggtaagccggaagagcgaagagaactgtttgacgaagcagcaggaatcgtgaaattcaaacgaagaaaagcggcatctttaaaaaaattagaggaagaacagcagaatctgacccgtgtcaatgatattttatcggagttgaccagacagcttgcaccgcttgagaaacagtctgagacagcgaagatatatttaaagaagcgggaagaattaaaagcgcttgatgtccggatgtttcttgcagaaatggaacgcatcaatgctcagttaaaagagatcgaagaaaaatcggagattgtccgtcaggacctggaaaaaacaggtaaggattttgagacaacgaagactgaatatgaagcgttagagaaagagctggaggcttttaatgtaaaaattgaagtgtttcgtgaagagtcaacaaaaaaagcactggagaagcagcagttagagggccagattaatgtagcaaaggaacagatttcttcggcaaagcaaagtgatttgcagtatcgtgagcgtgtggaggctttagaggcagagttaaaacagagggaagagagtgaaaaactttatactgaagaaaaggcagagcttgatgcaaaaatcgatgagattcggcaaaaagaggagacagcgaagaatttattcagggattttgcttttgaaattcatgaattagaagaacagttagaggaagataagagcgaaattattgaaattttaaatcatcgtggttcgacgaagggaaaaatgcagcgttatgatgcgatgatggaacagatttcgcttagaaagacagagtttaatcagaaatatctgcgtttaaagagtgagactgcaaagcaggaagaagaaaaggagcgctttgagaaagaacagcaggaaattgatgctgagattttaagtctcacaaagaagagtaataaaaacgaggatgagattaccagatatcagagtctgcttggaaagagtatcaaggaacagcaggttttacagaatgattatcataaagaggcttcgaggttagaatctttaagaaatattacagagcgttacgacggttacggaaacagtatccgccgtgtaatggagcagaagaaacgtgttccggggattcacggagttgtggcagatttaattaaagtagaaaaaaattatgaaactgcgattgaaaccgctcttggaggaagcatccaaaatattgttacggataacgaaacgactgcaaaacagatgatttcgtttttgaagcagaataaatacggacgggcaacatttctgcctttgaccagtatgggtgcaggacgtggattttcgactccgtctgccttaaaagagccgggagttgttggtgtggcaagtgagctggtttctacggaagttgaatatgagagtttaattgaatatctgcttgggcgtacgcttgtcgtggaaaatattgattttgcaattgcaattgcaagaaaatacaaatacagtctgcgtatggtaacgattgaaggagagtctttaaatccgggtggttccatgaccggtggtgcattcaaaaataacagcaatctgcttggaagaagacgagagatagaagagcttgagactaaagttgagagtttgaaaaatcagctggaagcaaaacaaaaagagattgatacttatcgggaaaaacgaaatttccatcgtgaagaagcaggacgattaaatgctgcacttcaggagcagtccttaaaggataataccctgcgtatgaatcagaaagcaatggaacagaaggcaaaagagattgcaaaagagtatacagatttaaaacgggatcttgcagcacttgaaaaacagacgcaggagattgaagaaaatcgggaatctattcgtgtggaattagagacgagtgataaacgagaggcccagttggaagatcagattaatcaaaatcaggaaaaactggatgagaagaaaaagcaggaaaacgctcattcaaaggaattagaagaactgcatttagaaaatgcagaactcagttccaaacagggatttgcaaaagaaaacctggaacgtatcttaagtgaaaagaagaatttacaaagacagttaatggaactggcagcaaatgtcagtgatgcaaaagatgagatagagaaaaaagaagccgagatagaaaaaatgcaggaggcagttgaagctgcaaagacacaggaagcggaagatgaagcgaagctgcaggaataccttgcaaaaaaagagagcatgaatcaaagtcataagggcttctttgaaaagagagatgagctttccggtcgcatgaatctcttggataaagacctataccgcctggaaaatcaaaaagaaaagcttgaggagaatcaggagaatcagataggttatatgtgggaagaatatgagatgacctacagtgcggcaaaagaacagacttttgaggaaccgcttgagcgcagtgaaatcaaaaaggcacaggcagaagtgcgaaatgaaattaaaaagcttggaaatgtcaatgtcaatgcgattgaggagtacaaagaactttccgagcgtcatacgttcttaaatgcccagcatgaagatttggtggaagcagagaagaccctgcttaagattattgatgaactcgatatcggaatgagacaccagtttgaagaaaaatttgcacagattcgtgaagaatttgataaggcatttaaagaactttttggtggcggaaaaggaacgattgagttagatgaagaggaagatatcttagaggcgggaatccgtatcatctctcagccgccgggaaagaagctgcaaaatatgatgcagctttccggtggagaaaaggcactcaccgcaattgcgctgttatttgcgattcagaatttgaagccatccccgttttgtctgctcgatgaaattgaggcggcactcgatgattctaatgtaacaagatatgccaggtatcttcataagttgacaaagaatacacaatttattattattacacatagacgtggtacgatgaccgcggcagaccgcctttatggtatcacaatgcaggaaaaaggtgtatctacccttgtttctgtcaacctaatcgagaatgatttggataagtaagagaagcagatgagaaaatacagaaaagagcaggagggacttatggcagaagaaaagaaagggttttttaaacgactggtatccggtcttacaaaaaccagagaaaatattgtatcgagtattgattctattttcagtggatattccagcattgacgatgatttctatgaagaaattgaagaaattcttgttatgggagatttgggaattaatgcaaccaataatattatcgaagatttaaagcgacaggtagcagagaagaaaataaaagacccgcaggagtgtaaaaaactgctgatggacagcatcaaagcacagatggcagtcggggaggcggcttatgaatttgagaaccgcaaatctgtagtgctggtgattggtgtaaatggagttggaaagactacttctgtcggaaaactggcaggaaaattaaaagaccagggaaagaaagttgtgcttgcagcagcagatacattccgtgcggcagcaggagaacagctgacccagtgggcgaaccgtgcaggggtagaactgattggaggacaggcaggtgctgacccggcatctgttgtgtatgatgcgattgcagccgcaaaagcaagaaatgctgacgtactgctttgtgataccgcaggacgtcttcacaataagaaaaatctgatggatgagcttcataagatttaccgcattatcgaacgggaatatccggaagcttatttggaaacgttagtcgttcttgatggaacgaccggacaaaatgcactgcttcaggcaagacagtttaatgaggttgcagatgtaacaggaattatcctgacaaaacttgacggaactgcaaagggaggcatcgctgttgcaatcgagtcagagctggatattccggtaaaatatatcggagtcggtgaaagcattgacgatttacagaaatttaattcggatgaatttgtaaatgcgcttttcgatttcaaagaagaataaagtttaagtggaacattcgtgaaacctggcaggcgattttaaccaggaagcattgaagctttcgcttcgtgtgtagttcactcagtacatatagtacatgctgaaaaatttcagaatcgccgaaaaaaacagttagatgaacatcaaaggaggatattaggattatgctgacattagaaaaatttgaagaagcgtcggaaatcgtaaagaaagtaacccaggataccaaactggtttacagcgattatttcagtgcacagacaggaaacaaagtttatttaaaaccagagaacatgcagaaaacaggtgcttacaaattaagaggcgcttattataaaatcagtactctttcaccggaagagagagcaaaaggtttaattacagcttctgccggaaaccatgcacagggtgttgcttatgcagcaaaagcatttggagtaaaagcggttatcgttatgccgactaccactccgttaatcaaagtagaaagaacaaaaagttatggtgcagaagtagtcctttacggaaacgtatatgatgaagcctgcgagcatgcttataaattagccgaagaaaatggatatacattcattcatccatttgatgacccggctgttgcaaccggacagggaacaatcgcaatggaaatcatcaaagagcttccgttagtagattatatcttagttccaatcggcggaggcggactggcaacaggtgtttccactttagtcaagctcttaaatccgaatatcaaagtgatcggtgtagaaccggcaggtgcaaattgtatgcaggaatctgtacgtcgcggagaagttacaacacttgacagtgtaaatacaatcgcagatggtactgctgtaaaaacaccgggagaaaaaatcttcccatatatccagaaaaatgtggatgaaatcattaccgtcagcgatgatgaattagttgttgctttccttgatatggtagaaaatcataaaatgattgtagagaactcaggtctgctgactgtagcagctttgaaacatctgcagtttaaagataaaaaagtagtttctatcttaagtggtggaaacatggatgttatcacaatgtcatctgtagttcagttgggtctgattgcaagaaatcgtatctttactgtatctgtgctgcttccggacaagccgggtgaactggtacgtgtggcaagtgtaatcgcagataagaaaggtaatgttatcaaacttgaccataaccagtttgtaagtacaaaccgttctgcagcagtggaactgaagattaccattgaggcatttggtacagaacataagaatgaaattattgaagcactggaagaagaaggatatcgtccgagacagattactgcaaacttatagaacgcaaagacgcagcaatttcgtgcaggcacgctctcgctacttgtcgctggcagcggtacataagcgacaaagtcgctaagtaccggccgctccaaagtgcctgcagaaatttgctgctaaataaaaatgagagggcagaggtataggaaaaaaattgctctttgttagaaaattagatagttaggagaaatcgtaattacaaacgttaagtttttcaatttgtcgctgttagaaaaattggatagttaggagaaatccctgagtttctgtatgtaacatagaagagattcaggggttttcttatatctgaaattgtgcgagaagaaaataatacttattcctactgaaatagtagtgaaataaagagagatgtgttagaattaggacgtcggatgtattttggaatatctggcagggcaggaggtttgttatgagagagttatatttagagtgttattctggaatcagtggagatatgacagttgcagctttattggaccttggtgttccgggggagtatctgatgaaagagttggagaagctgcacttagatggatatgagataaagatttccaggacaaagaagaatcagattacagcgacagattttgatgtgattttgaaagatgagcataaagaggagcatggtcatgaacatgctcatacccacgtaaatgatgaagatgtgaaggaatgtcatgagcaggaacacagtcaggaacatacgcatgttcataatagttatcgtgagattaaggaatttattttggcttcagagctctcggacagagtgaaggaaatgattttaaagatttttcaggtgattgcagaggcagaagcgcaggttcatggtacggctgtggatgaagtgcattttcatgaggttggtgcggttgattcgattgtagatatttcggcagcagcaatctgtctggattatttgggatttgattcgattgtgacttctgaaatctgggagggaaaagggcatgtatggtgtcagcatggaagaattccggttccagcaccggcagtacttgcgatttttttaaagagccagacaagacttcatctttcaggagtgcagggagagatggtgacaccgacaggggcgggaattgtggcagcgctttcgggtgagaatcagcttccggattcttttgtaattgaaaaaatcggaattggagcaggaaagaaagatttctctcatgcgaatgtgcttcgtgcgatgattttaaatactgagaaagagaaaaaggcggtgcatgaacataagcataaatatagtcatgagcaggaacacagtcatacacattgccatgaggagcaggaaatcgaaaaaaaaaagacagctgtaaatgagacaaaagaagaaacgaaaaataaagatgagcagaagggatttcacgatgtccagacagaaacggtatgtgtcatggaaacaaatgtggatgactgttcgggagaacagctgggctatgccagagaggtattgttaaaggccggtgcgctggatgtgtgttgtatgccgctttacatgaaaaaggggcgtccggcatatttgtttcagattatctgcaaaccggcagatgaagaggcattaaaaacaattttatttagagagacaaccagcattggatttcgcagatatgaggaagaacgacaaaaattagaccgtgaaatgataagtgtcacacttttggatggaaataccattcggattaaaaaatgtatgcatcatgaggtgacttattattatccggaatatgaggatgtcaggaaaacctgtgaaatgcgtggtgaggcatttcggatggtttatgaagaggcaagaagtttggccaagaaaagtgaggagtgataagaggtggaattgacgcaaaaagaagagcgattatatgagattatgaaggggtatgcaaagaaggatttatgtattgcgttttcaggtggagcagacagcagcttgttattaaagcttgctgtaaaatgtgcagcacctggggtaagggtacatgcagttacttttgaaaccgtactgcatccatcctgtgatttggatattgcaaaacaggttgcaaaagaaaccggagcgattcataaaatcattttcttagatgaatttgaagatgaaagaattaaaaagaatccgaagaaccgctgttatctgtgcaaaaaaagtttgtttgaaaagctgttggcttatgcagatgaagcaggggcagaaaccatcttggaaggaaccaatgaggatgatttacatgtgtatcgtccgggacttgcagcagtccgggaacttggagtaaaaagtccgcttgccgaggcgcatttaaccaaaccggaagtacgtgcccttgcaagaaaagaaggaatttccgttgcaaatcgtccggcagctccctgtcttgcaacacgtctgccctatggttcagaacttaactttgaagtgctgaaaaagattgatgagggcgaacaatatatgaaaagtctgggatttgagattgtgcgtatccgtctgcacggaaatgtaacaagaattgaggttccggtagctgagtttggaaaatttatggaacaaagagaagcagtgcttgcaaaattaaaagaacttggatttgtttatgtgacacttgatatggaaggatttcgaagtggaagtatggatgtcgatgcccacgacgcttgacgaccacgcagcagatgaaaaatcaggcaagtagtgaagtagattgcgaagctccgcttgactatgcgctgtataagtgtcaagaaaaaatacttgacacttcaaaaatcatgtagtatgataagcaaggtgatgacaagtggaacaatttgtacagcagactttattatacgatttttatggggaacttttaacagagcaccagcgcagaatctatgaggatgtcgtgctcaatgactactcacttagtgaagtggcagcagatttgggaatcagcagacagggcgtgcatgacaacgtcaaacgctgtaataagattctttcagactatgaagaaaaattgcatctcgtagagaagtttgtaaatattaaggaaaaaatccacaggattcacggtcttgcaaaaaattgcgaaagcatcagcaaggaagaactggtttccgaggtggaacacatttcccaggaaattttggaggagttgtagcagatggcatttgaaagcttaacggataaactacaaaatgtatttaaaaacttgagaaaaaaaggccgtctgacggaagccgatgtaaaatccgctttgaaagaggtcaaaatggcgcttctcgaagccgatgtaagttttaaagtggtaaaacaatttatgaaatccgttcaggagcgtgcagttggacaggatgtaatgtccggcttaaatccgggacagatggtaattaagattgtaaatgaagaactcgtaaacctgatgggaagtgagacaaccgaactcgctttaaagccggcaggagagattaccgtacttatgatggtaggtcttcagggtgcaggtaagacaacaaccacggcaaaactggcaggcaagctgaaatcaaaaggaagaaaacctcttctggtcgcatgtgacgtataccgtccggccgcaattacacagttgcaggtcaatggtgaaaaacagggcgtggaagtctttgcaatgggggacaaacaaagtccggttgatattgcaaaagcagcgtacgagcatgcgaaaaaagaaaaatacaacgtggttatcttagataccgcaggtcgtcttcatattgatgaggacatgatgcaggagcttgcaaacataaaagaagcgatttctgtagaccagacagtactggtagtcgatgcaatgaccggacaggatgcggtgaatgtagcagagaccttcggtgagaaagtcggaatcgacggagtcattcttacaaagatggatggtgatgcccgaggcggtgcagcattatcaattaaagcaatcacaggaaaaccgattctgtttgtcggtatgggagagaaattatcggatttggaacaattttatccggatcgtatggcatcccgtatccttggaatgggcgatgtgatgagcctgattgaaaaagcgcaggcaaacattgatgaagaaaaagccaaagagatggaacagaaattccgtaagaactcattcggctttgatgattaccttgaaagcatgaatcagatgaaaaacatgggaggaatttccagtgtcttaaatatgattccgggaattggcggacaggtaaaagatattgaaaatatggtagacgaaaaggatatggcgagaaaagaagcaatgattctttccatgacaccaagagaacgttctcatccggaaatcctgactccacagagaaaagcaagaattgcaaaaggtgcaggagtggatgtggcggaagtcaaccgcttagtaaaacaatttgaacaggcaaagaaaatgatgaaacagatgcctggtcttatgaatggcaagggtgctaagaggggaaaatttaaacttcccttttaacatataaatcaagaagataagaaaagaaaatagttaaattttaggaggaaaaaataatggcagtaaaaatcagattaagaagaatgggacagaaaaaagctcctttctatagaatcgttgttgcagattccagatccccaagagatggtaaattcatcgacgaaatcggaacttatgatccaaatcaggacccaagtgtatacaaagtagacgaagaagcagctaaaaaatggcttgctaacggtgctcagccaacagaagttgtatccaaaatcttcaaagcagctggtatcgaaaaataatataggtccaggaggtggcttgtaatgaaagaattagttgaagtaattgcaaagtctcttgtagattatccggacgaagttgcggtaacagagcgggaagaaaacaatgcggtatttgtagaactcaaagtagcatctgcagatatgggcaaagtaatcggacatcagggaagaattgcaaaagcaatccgtaccgtagtgaaagctgcatcttccaaaaatgataaaaaagttatcgtagatattttacagtaaaagtaaatgagagggctgtacacgttgatgtgcagtccttttttgggcgaaaaagtaaattaaggagttataaataagtatggaagatttattacaggtaggtgtcatcacaaccacacacggaatccgcggagaagtaaaagtctatccgaccaccgacgatgtacaccgctttgaagaattagaaagcgtattattggatacaggaaaagaatacagagaattaaaaattaagagtgtgaaatatttcaaacaatatgccatcttaaaattcaaaggcattgataatatcaatgatattgaaaaatataaagggaaaagcctctttgtcacaagagaaaatgcacaaccgcttggagaagatgaatattatattgcggatttaatcggcatggaagtttacttagaggatggaagtcattttggaacgttaaaagatgttatggaaaccggtgcaaatgatgtttatattattaagacggaagaaggaaaagaagtgctgattccggccatctacgaatgtattttagatgtcgatgtagaagcaggaaagatggaaattcacctgttggacggattagtgtaaaaaaggagaaaaacaaatggattttcatgtactcaccctgtttccggatatggtcagacagggattaaataccagtatcatcggaagagcaataaaagacggacatatcacattaaatacagtcaatatccgtgatttttctgtcaataaacataatcgcgtggatgattatccttatgggggcggagccggaatggtaattcaggcagaaccggtttaccgcgcctgggaatctgtggcaaaaaacagtaaagccataaaacaaggcaaaaaaccaagatgcatttatctgactccacagggaaaagtctttcatcagacgatggtagaagaatttgcccaggaagaagaactgatttttttatgcggacattatgaaggaattgacgaacgtgttttagaagaagtggtcacagactatgtctctatcggagattatgtgctgacagggggagaacttgcttctatggtcatgattgacgctatctcaagatttgtaccgggtgttttaaataatgaagaatctgcccagtttgaatccatgcaggataacctcttagaatatccgcattataccagaccggaaagctggcatgaaaaagaggtgccgaaagtactcctaaccggagaccataataaaattgaagcatggagatgggaacagtctctgatacgaaccaaagagagacgaccggatttactcgaaaaaaataaaagtttaaaagtggcttatttcagcccgaccggaggcacaaagaaagcagcggagatgttagcaacgatgctctcccagaatccggaatacattgatttgacgagaagaaaattccggaaacaaaaacaatactttggaaaaaaagatttattgcttgcagctgcaccggtatacggaggtcagcttccacagttaaaagaagctctttttacaaacttgaaaggggaccataccccttgtattttgatgtctgcttacggaaatcgtgactttgatgatacccttgcacagatgaaagacattttagaggcgagaggattttactgcatcggcgcaatcgcaccgattattccacacatttattccgaaaaactgggggcagaccgcccaaatgcagaagatgagaaagtcttccgccggtttgcagttacagtgaaacagagattagaaaatggattggaagaatccctcatgattccgggaaatccaaatccggaaccaaagaccatgaagccggtggttcattactttgatgaaacgaaatgtaaaggctgtcagacatgtgttcaaaaatgcccgacctcagcgattaataaagacacatatcaaataaaggaagaactctgtgttggctgtctgcgctgtgaaagggtatgttcgggtggggcaagaagcagtgactatgaaagtgttaaaaaatatctggaggacaatttctgtcatccaaaagaagtaagatggtattaaaaggaaaaatgacgaagaaatttacaataatgtggtagaaaatggcggattgactcttgtcttgaaaaaaatagatgatatcattaataggaaaaacagccagatgaaacgaaaagaaggggagttcaagaatactggcaagtacgaaagcgaaggggaaagagaaaaatatgtatctaagagagtcaaaaggttggttcaagcattatgattttattctgctggatttaatttgcctgcagatagccttttttctggcttatgtgctccgtgggatgggctggaatccgtattctcatgtactttatcggaacatggcaatttttgtagaagcggcagacattgttgtgattttcttttttgagacattaaaaaatgttttaaagagaggacactatgtagaatttatagagacactcaaacatgtgctgattgtgtgcgcagtgtcgatgagttatctgtttttgattaaagaagcagaaaagtattcgagatttattctgattacgacaatgtgcttctattttatcctgacttatacagtaagagaagccagaaaatcagtattacaaaaacagatggaagccggaaaagaccgctccctgctgattgtgacgacttcggatgttgcaggaacagtaattcgtgatatgaaagaccacaattatgcgagatttacactttccggaattgcaattattgacaaggatatgacgggaaaagtaatcagtggaattccggtggtttcaaatcgagaaaacacaccggattatatctgccagcaatggattgacgaagtgctggttgtaccgtcggaagatgcagaatatccggaagatttgatgaagaaaatgatggaaacaggtgtaacggtacatttaaatcttgcgaaagtatcgaatacgagagggaaaaaacaatttgttgaacaaatcggaacttatacggttctgacaacaacgatgaattatgcaacagcaagacagctgtttttcaaacgagcgatggatattgcaggcggtttggtcggatgtattttaacagggcttatcactctgtttgttggacctgcaatctacataaaatcgccgggaccgattttcttttctcaggaaagagtcggaaagaacggaaaacgattcaaactgtataaattcagaagcatgtatttagatgcagaagaacggaaagcagaactgatgaaagataataaactcggtgatgcaaagatgttcaagctcgactttgacccacgtgtcattggaaatgaaatccttccggatggaacgaaaaagaccggaattggaaactttataaggtccaccagtctggatgaatttccgcagttttggaacgtgttaaaaggcgatatgagtatcgtgggaacacgtcctccgttgattggagaagtttctgagtatgagctgcaccatcgggcacgacttgcgataaaaccgggaattaccggtatgtggcaggtaagtggaagaagtgatatcacggattttgaagaagtggtagggttggataaagagtatattgaaaattggaatatcggattggatattaagatactgttaaagaccgtgatggtagtgtttaaaaaggaagggtcggtataaagatgagagatttgtgattctgtttaagattggggagatgttaagcagaatcacaatttgtgtatagagatatcttatactgaaaggaaagaaaacgtgaaaaataagaaattacgaattgcagttttaggacacaaaagaattccttcacgtgagggaggaattgaaattgtagtagaagaattatctgtacggatggcaaagatgggacatcaggtaacagtttataatagaagtggacatcatgttagtggaaaagaatttgatgcacataagctgaaagagtataaaggaactcgaatgaaatacgtaccgacaatcgataaaaaaggtctggcagcaatgagtgcttccttttttgcagcggtagcggcagcatttggaaagtatgatgtggttcattttcatgcggaaggaccatgtgcgatgctatggcttccaaaactgtttggaaagcgttgtattgctacggtacatggattagatcatcagagagcaaaatggggaaaactggcaagtacctatattatgcttggtgagaaatgtgcggttaagtttgcagatgagattattgtattaagtgaaggagtacaaaactatttccttgatacctatggaagaaaaaccagatttattccgaatggtgtaaacagacccgttatctgcgaagcagatatgataaaagaaaaatttggacttgaaaaagatagttatattctattccttggaagattagttcccgaaaaaggacttcgatatttggtagaagcgtttaaacaggttaagacagataagaagttagtgattgcaggaggaagctcagatactgatgaattcacaaatgaattaaaagaaatggcaaaaggagatgacagaatcctttttactggctttgtacagggaagagaattagatgaactgtacagcaatgcgtatgtctatacacttccaagtgatttagaaggaatgccacttagtttattagaggcaatgagttacggaaattgctgtctggtttcagatattgatgaatgcgcatcggttgtggaagataaagcgtttgtgtttaaaaagagtgatgtggcggatttaaaagaaaaactacaaaaagcttgtgatgataaagtgcaggttcagaagtataaagatgaagcagcggattatatttgtgggaaatataattgggatgaggttgtcaagaagacgttagagttgtatgagaagaaagggagcaagtaaatgataagggtattacattcggtaagtaatatggatcgagctggtattgagacgatgcttatgaattattatagacatatggatcgagaaaaagtgcaattcgattttttatgtaataagacaaagccaggagcctatgatgaagaaataaaaaaaatgggtggtagaatttatcatacaccgggtttgaatccggcaaaatatcctcagtatttaaagtatatgaaacaactttttgaggagcataaagagtaccgaattgtagaggcacataatggggctctaggcgtgtatgcgttgcatgcagctaaagttaataagattccagttagaatttttcatgcgcacggtgcaagtattacaaaagattggaaattgccgattaagcttgtttgtaagtctatgctacctgcaaatatgaatcatcatttttcatgtggaatagcagctgctagatgttactttggagataaagttgttgataataatgattatgaattgattccaaatgcaattgaagtggagcggtttatatttaatgaaaaagttcgtactgctatgcgtaaaaaatatggatttgaaaataagcatattataggacatgtaggaagatttatgacacaaaaaaatcatgcttttttaatagatgtatttgaagaggtttctaagaaagactcacaagctatgttagttttacttggtgacggagaattacaagaggaaatcagaaaaaaagtaaatgaaaaaggtcttagcgataaggtctattttgcaggtaacgtgggaaatgcaaatgaatggtataatgcatttgatgtctttatgttaccgtcagtttgggaggggcttccagttgttggtgtagaggcacaggcaaatgatttaccatgtattttttcggaaagtgtaacgaaagaaattggtctttctaaaaaggccgaatttttatctctacaagaaactcctttagtttgggcacaatgtgtattagataagttgaaagaatcaaataggaaagataatacgcagttaattacagataataactataatattagctatgaagcaataaaattacaagaaagatatttagaattatacgaggaacagaaatgaaaataggaattttaacacatcattatatcaataattttggcgcctttctacaagcatattctttgcaacaggctgtgcaagacttatatccagatgatgaagtttatattattgattgtattaacttaaaacattttattattaatgcaggtggatggttccgattctataaaaataaagagaatttatctaattggtttcagaaaatacggcttccttggacttttgcgaaagctagaaaaaagtatatgaatctaactcatatttgttatgatgcaaaaggaattgaaaaattaggactggattatattatagtaggtagcgatgaagtttggaattatagagaaacaaaaggaaatgcaaaagtaaaatttggtattggtttgaataatgaaaaacttattgcttatgcaccaagtgttggacaaacaaatgatttggaagtgccagattatgtaaaacaaggaattttgaagtttaaggcagtctcagcgcgagatgctctaacggaaaaattagccgaaaatattagaggagaaaaaatcgagagggtagtagaccccacgttccttagtaaaattccagtagaaccagttgcttccgtaaaaaaaccatatatattattttactattgtgacggacttccagtagaagaaaaaaataaaatttttgaatatgcacaaaaaaatggattggcagtatatggagcaggagagtgtgataagcattatacatctactacggtaaatcttactccatttcaatgggtttggatgtttaaaaatgcatcgtatgttgttactggtacatttcacggagcggtattttcaatgctaaatcatagacaatttgcttgttatcttacgaatccaagcagaataaaaaaagtgacttcgcttttagaagagtttaaattagatagccgctgttgtgatgctaatgcagataatattattgcaaaactaaaagagaaaatagactataaaaggacagaagaagaatttgaaatgcgacgaaattctagtaaagtttttttaaaggataatataaattgaaaagacaaaaagacttgaaagttatatataggagaaaatgatgggaattattctgtttgatgagaaaacaaagtgttgtgcttgtggagcatgtaaaaatatttgtcctaaaggtgcgattgcaatgaaagaggatgaatatggatttctgtatccacagattgatgagaaaaaatgcgttcagtgtggtatatgtaagaaagtttgtgcttatcaaaatggacaagtcaaaaatactccgattaaatgttatgcggctgtaaataaaaataaagttgaattaatgaagtctgcatctggaggaatttttgtagctgtcgcaacttctgtgttaaaagaaggaggagttgtgtttggagctgcattagattttgaagatggacatgctcatccacatcatattgcagttagggaaatttcccagctgtataggttacaaggctctaagtatgtgcagtctgcgattgaaaatacttatgaagaagcaaaggaagaattgaatctaggaaaaaaagttttattttctgggacaccgtgtcaaattgctggattgtatggatatttgagaagagaatatgagaatttgtttacagtggatgtgatttgtcatggagtacctagtgctaagatgtttgatgattttcttcaaaatgaaacaaataagagaaatgttaaaaaaattaaagagtatatttttcgggataaaaaaagaggctgggggatgaatggcaaaatacgatttgaattaaaaaatggaagtgaaaaaactgtttatattcctgctagactgacctcttacaatacttttttcttggatggatttaattatagagaaaattgctattcgtgcaaatatgcgaattcaaagcgaccaggtgatattacgttaggtgattattggggaatagaaagggaaaatccggaattacttaaaaataaagagtatgatatagaaaatggaatatcgtgtattattgtgaatagcaaaaatggaatgaaaataatgcaaaatataataaatctgtcaatgtatgaaactcaatttgaaaaaatagcgaataaaaatggacaattaaaatatccttcgaagcgtccagcaaagagggaacagataatgaagttatattttcagaagggatataggggtgtagatgaatatttttatagaaattataaaaagcagataattgtacatacagtatttaatgcttttccgattggagttcggttaaaaataaaaaaagtattgcataaataatttaggagaaaataaatgtcaaataataatgaattaataagcattatagttcctgtttataatgtacagaagtatttagatagatgtatgaatacattattaaaccaaacttataaaaatattgaaataatattgatagatgatgaatcaccagatagttgtccgcagatgtgtgatgaatataaaagaattgaccagagaattaaagttgtacataaactgaacgaaggcttagggtttgcaagaaatagtggattagaaatagcacggggaaagtatataatatttgtagattcagatgattatgtgacagaaaatatgtgtgaattattatatcaatcagcgaaaaaatatgatgcagatgttgtgtatggtgggattttttatgcggatggtaaaaatataaaagaaagtaaggctgtaacaaaagaaagaatatggaaaggaaataaagaagttaaatctttactgttggattttattgcaacaaagcctcaagaaaaaaaagatacaattatggaggtttcagtatggaaggctttatttagaaaaaaaatttttgatgattataatataaattttgtttctgaacgacagttcatatctgaagatataatatttgatattgattatttatccaaatgtaattgtgttgtagcaattccagagccagtgtattattattgtgtgaatcctaattcattatcaaaagtatttcgaacggatagattttacaaggtaaaaaaactctataaagagattatacggaaattaacacctatttatggaatagaggttgttaataagcgtggagataggtttttaattgcgcgtgctagaacaaatgcaagacagattgtgcggcatgaaaaaattattggaaagaaagaaatgatatcggctttacatagtatttgtgaagatgaagatatgaaagaaatatttagaagatatccaatttatttattaccatttaagtataaattagtggcatatttgatgaaatatagatgctatcatatattaaaaattgttctaggaaggtaggaaaattatgtttacacaatcaaaagatataaaaaaagcaaaattgatgatgtatttaataccgtctgcgcagaagagaacgaagtggttaaagaaacataatgttttttatacaatgggagacaactgttattatcatacaaaagatataccagcagaaccgtatttactttcaatacatgataatgttagagtagctgcaaatgttagatttataactcatgatatgattggagttatggttaataaaatagaaaagttgaaaagtgaatatggacgaatgaaatattatataggttcaatagaagtatatgataatgtgatgataggagcaaattccactataatgtatgatgtaaaaattgggcctaatgcaattgttgcagcaggaagcgttgtgacaaaggatgtgccggaaggcactatagttggaggaaatccagctaaagttattggaaagtttgaagactttgttgtaaaacgaaataaaaaaacagaaaatagaccggagaagacagatggtattaatgacataatagaatatttttggaaagaaaaaacggaagaatagaaggagaaaatgatatggcgattatatatattatttccatggtggtagcattttctttttattttggtggggcacaagttgttttttggtataaatatttaattgcacttctttgggcactttcttatttaggagtttgcatttttaaagaaaaaaagataaagggaaatagtgcgataattataaaaatgtatgtttatccgttgttaaccatattagcatggtcctcctttatttttatatttcattcaccaagtggagctaatattggaaatgttacaagaatggtaagtaatattgtctatttaattctagcagttactagtgctgtttcaacgacatactattttggaaaaaaagtaattaaatattctatatgggcaatttttataagtattatggctaacctcatatattgtatacacttatatggtttaggaatttttctgcaatatttaccacaggcagcgtcaagtacagattttccttttggctcagtattatacaattttgcaagttgtatagaggtgcaagatgctacattggcgacaggtttttatatattatatatgatattgtttgatgaggaagatagtataaaaacaaaattgttctatatgggtctattacttgtttgttcatatttaggatttaaaagaactgaatttattgcagtaatatttacagtaatagttatgtggataataaaaaaatatgcaattgatttatcattaatgattaaagtaataggaattgctatattactgtttagttttggctatatatgtattgtaaaatgggacttatttcaaacaataatagataaagtgggagctaatgttacagggcgtcaaaatgtttatcgtaatttagcaagatattatgaaatatcaccgctttatattggaaaaggatttacatttgttgataaaacaatgtatgatactacggggttttcagcacataatacagttgttcgtatgtacgctgaattaggatttattccgtttattatttggattgtttggtatttaattcgaattcctttgaaaatattaaataaatttggggaaaaaaatgcgttaattgttatgacaagcacattgtatctattttttacatattgtataggaaattctatgaacttttactgcatacagtatagttttatattgattacagtagctactttcgatagtaatgggaaattgaactataaaaaaattaggtttaaaatataatcaaggagataaaaatgcagttatttgatgataaggggaaatgctgtggatgcggattatgtgcagctgtctgtaaaaaaaaagcaataacaatgaagatggacaatatgggatttatttatccagaaatagatggaaacttatgtattgaatgcggaaaatgtgtaaaaatatgtagttacaataatcaagaaaaattttatacaccaatagaatgttatgcagcattagcaaaaaataaagatgtattaagtaaatctgcgtcaggaggaatatttgcgacaattgcaaatcaatttattgaatcagggggatggatctgtggagctgtcatggattttaaagatggacgagctttttgctatcatttggtaactaataagcttgatgatataaaaagaatgcaaggctctaaatatgtacaaagtgatattacggatgcactgttaaaaataaataaattgattcaacaaaaagaaaaaatacttttttgtggaaccccttgtcaagtttcagcgatacaaaaattatctataaattatgaacagttatatacaatagatattatttgccatggagtaccttcagtacatttatataatgaatttttgaaatgtaaagcatctaggaatggagaaatttgtggctttttatttagggataagagcagaggaaaaggatttaaagcaaaaattatagaaaaaaaaggcaaggaaagaaaggagagaatgtatccagcacatctgttatcatactatcattatttcttaaagtcattgatatatagagaaaattgttatacatgtaaatatgcaaaagaaacaagatgctctgatatgacaataggagattattgggggatacagaaaatatttgagaaaaaaatagaactggattttgaacagtcttggtcatgtgtaataattaataatataaaaggaaaagtattattagaagaaacaaaaacatcatttgatttggtacaaactcaattaaatgatataaaacaaggaaatgctcagctaagtagaccgagtcaaaaatcggaagaacgtgacaaaatattgaaactctttgaaaaggaaggatataaagctgtagaaaaagattttaagagaaaattaggattgaaatactatggattactattgagaaattacatgtttggtcgataggagaagctatgaatagtgatgaatcaagaacaaaaaaatcaataaataatataataggtggtttaatgtttaagctaatagcattattcttcccatttattattaaagtagtaatgataaaaaaattaggagtacaatatttaggattaaatagtttgtttacttctattttaatggtcttatcattatctgaattaggtgtaggaagtgcattagtttatagtatgtataaaccaatggcagaaaataatatagatagaatttgtgcattattaaaaatttataaaaaattttatagaataattggagtggtaatttcagtaataggattaatgctattaccatttttaaaatttttgattaatggaacatatcctaaagatgttaatatatacatattatatttaatatatttggttaatacagcactaagttattttctgtttgcgtataaaaaatcattatgggaagcatctcaaagaaatggaatagaaagtagattagctgcatttacaaatgcaggtatgtatattgctcagattttagcattattatttacaagtaattattatgtatacattatatttttgccattaagtactctgattcaaaacctgataagaagtgttatggttgataaaatgtatcctcaatttgaatgtaggggagaactagaaaagggatttattaaagaattatttaataaaatcaaagctttattagggcataaaataggttcaactgttataacagcagcagatagtattgttatttcatcaatcttaggacttgaaatattagctatatatggaaattattatcagattattaatgcgttaattggagtagttagtgtaatctatacggcaataactgctagtattggaaatagtattgtagtatctgatgataataaaatttattctaattttaaaacgttaacttttatgaatagttggctggttggctggttttccgtatgtttatattgcttatatcaaccattcatgaaaatctggatgggagaaaaaatgttgtttcctaattatatggttatattatttgcaatatatttttattcttggttagttagaagaataggactaacctataaagatgcggctggtatgtgggaacaggatttttggaaaccatatgtgggagtagttgtgaatttagttgtcaatattatattatgtaaaattataggagtagctggtgtattaatatcaactataattgttatggttgttatttattttccttgggaaacgtggtctttatttaaatatctttttaaaagaaaaccaggagagtatttgctaaagatgtttatgtacttagcggtaacagttatagttgctcttgttactgattatttgtgtaagtgcataaatatatatggaatactagggttgatgataagaatgctgatatgtatgttagtacctaatattatatatttaatggcatattttagattaccagaatttcaggatggaaaaaaaagagcacttaatttaattagtagtaagaaaaaatgatataggagacagagtgaatgaataagaagaatatttgtattattacacaatgttcgttgccaattccaacaactaaaggaggagcagttgaaactttagtggaataccttttgacagaaaatgaaaacaaggcgaagtatcattttactgtggtaagtgtgggagataatcaagctgaaatacaatcgagacagttcaaaaatgctgattttatatatataaataaatctaatgaattattgaacagattattatttcaaatatatagagtgttaaagcatgtgaatatttatattccattttcactagaatttaaaaaatgtctccaaatattaagaaacattaaaaaccaagatttatttatttttgaagcaggtccgacaacacagttacctgctttaagcaagattattcctaaagataaattactggttcatattcactgggatggaatgggaaataagcgaaaagataagtgcttttcttacttgataccagttagcaattatataggagaacagtggaaaaagaatacaggatgttcagatggaaagataaaagcattgtacaattgtgctaatatagaacgatttgaaaaaacaactacggaacaagagcaaaaagaattaaagaaagaattaggaatagcagaagaaaataaagtgattctgtttactggaagaatagtggaagaaaaaggtgttcgggaactattacaagcatttcagcaaattaaatataataatgttacattattgattattggaagtgctaattttggaagtaagacaaatacaccatatgaaaaagaagtatcccaaatcattaaaaaatcttctaaacaaattgtatttacaggatttgtacatcaaactaaattatataaatattataatatagcggatatagctattatgccgtccttgtttcaggatccagctccattggtaggtattgaatgtcaggcaacgggtactccattaattgcaaccagagtaggaggaatcccagagtatgtaacaaaagaaacagcaatattaattaataaggatcaagatatgataaaaaatttagctgataagatagattttttattaaataatcctgagattatgaaaaatatgggagaaaaagcaaaacaaaatgcaaaaaaatataatacggaaatgtattataaacatttttgtagactagttgatgaaatattataggaaagagaaagacgaaataatggaaatagcgatattatcaatgcaaagagttatcaactatggttcggtattacaggcatattcactaaaaggtattattgaagatataacaggagagcaagtagattttattgaccctgtccttgaaaatactatggctgtagatatgccagttagggactctgacgattatgaaaaaaaagaacagtatggtatgtggttaccgagaaatgttaaaaaggctttagataaaataaactataaaaggttgacaaaaaaaattataaaatttcaggaaaatgaattgggaatatcttatagttatgatccgcacaagaaaaaatatgatttggtaattgagggaagtgatgaagtttttaaagcttctgataaaatttacttatacatgtatggagcaattaataatgcaaatactttaattacttatgcagctgcatgtggaagtgcatcaatacaagggttgagtgaaaaaaatcgtacgatattaaagagtctaatgacaaaatataaaattatatcagtaagagatttacatacatataactatgtgaaaaatttatatgatggaaaagtggagcgacatctggatccggttttagtaggggatttatacaaaagaaaacataatccagtaaaattaaaaaagtatatgattgtttatgcatatggaaatagaattcgagacgaaaaggaaataaaagctattaaaaactatgcgaaaaaaaatggcttacaaacgatagcggtgggagcaccacaattttggtgtgataaatttttagtagcgtcaccacttgaagccttagattatttttattatgcagattatatagtaacagatacatttcatggctctattttttcggttattaataaacgtaattttgcagtaatattaagaaaaagcaataaaaataaattagggggattattgagagatttggatttagaagatagaattatagatgatatggataatcttcctaaaatattagaaaaggacattgattatgcaaaaattgatgctttattgaataaggaaagagtaagaactagagcgtatttgacagagcagattgaaagtattgagtgtaggtagaagattggtgtaaaggtatagtctgataaaaatataatcaaggagaggctgaatgcatttaagaaaattgtttagacagttgttatcgcttcctaaaacagtatactttaattttaaagttttagagttaaaatatgcgattaaacttccattttatatagataaagatataagatttggaaagctatacaaggatattgtgaaattaaattttgagccaaaaagattttcaataaaattcggagaacaggtagtagatgggataccagaaaatacaaaaggatatgtgtcaatgtcaaaagactcgtgtatagaatttgatggatatgctgaatttgcatatggaatttctttttatacgaaagaaaacgcatatattaaaattggctctgatttttactgtaataaaaattgcgtcattgctgcacgcaaatctattaaaattggaaataatgttcttatgggatggaacattagtattatagatagtgatggtggtaatcatttggtatatgaaaatgatgtacttaaggaaaataaaaaagatattatattaggaaatcatgtatggatatgttcatgtagccatattatgaaaggggttactataccaaatgatacaatagtggcatataattcgtgcgttacaaaatcttttagtgatgaaaatagtattattgcaggaagccctgcaataatagtaaaaaggaatattaagtgggaacgatagttatataaaaaaattaatcataaaaaggagaaaacacaatgacaacaaccctagtaatcatggccgcaggtatcggttcccgcttcggcggtggaatcaaacaacttgctccggtaggtttaaacggagaaatcatcatggactattctatccatgatgcaatagaagcaggttttaacaaaatcgtatttattattcgtaaggacatcgaggatgccttcaaggaagcaatcggtgaccgtatcgaggagacctgcaagaaactgaatgtagaaatcgcttatgcatatcaggaattggatgcgcttccagagggagtagaacttccggcggaccgtaccaaaccttggggaaccggacaggctgttcttgcctgcaaggatgtgcttcatgagccgtttgcagttatcaatgcagatgactattatggaaaggaagcatttgtgaagttgcatagttttctggaaaattatacaccagagaaagcaaatgagttctgcatggcaggctttatcctgaagaatacattaagtgaaaatggtgcagttaccagaggagtctgcaaggtaaatgaagccggttatctgacaggtgtagatgaaacttctaatattgtaaagatatcagagggtgcagctgtggaaaatgacggtgtgcttacaccgattgatgcagagtcttatgtttctatgaatatgtggggcttaacaccggagtttatgcagactttggaggatggatttaaagaattttttgccaacatgggagagaagaatatcttaaaagcagagtatctgcttccgatttatattgatgaactgcttcaggcaggaaaggtatcggttaaggtgttagactctcatgataagtggtttggagttacttataaagaagataaagagtatgttgtgaaatcttttgcgaagctgattgaagatggtgtatacgaaaaacagctttttggagatttaaaataataagacgagaaaaggggcagaaaaaacatgacattagtaaaaagtatcctgacaaatattcttactgcgttgtatcatccattctggtttgcggtgatactttctgtgtttattctgtttttttatctgtatgcgtataagcctgacaatgccggaaagggaataaagcaggtttgtattgcctggattttaaattttaagcagtcttctttttttagaaggctgttttgccttgtgttttttacagtcatgattcttttccagacgcttttaaatcgaaacctgtgggcaaatccattatcaaatgtcatgggcggatggtggatttggaaaaaagctgcggatggaacagttactttgacaacagaatgttttgaaaacattgcgcttatgatgccgtttacgatttgcctcatgtggacagcgaaggaaaaggtcatcctgaaaaaacgagatggacagataagaaataaaatctggtttggctccattatatgggcatgtggaaagacagcatttttgttttcagtttcgattgaatttttgcagctattccttagacttggaacgtttcaactatccgatatctgctacaatactttaggcggagtgcttggtggaatcatttactggattgggtggaaactaaaatgtgaacttccgaaaaaatctgctttaaacaaattccaggtctgatatagtggttcagggagacaaaaaactaagctttttataatgaactgatatatgtaattgggtaggggggagaaaattccccttaccctgattttttgagggctgattaaattaacatgaaaatatgaaagataaaatatggtaggtagaccgtaaacggtgaaacgagagtaccttgacgaagataagaccgcttttgcggtccaatcattcatcacttgttttctttggttttcggatatgctctggcagtgtttttgaccaaggcagtaattcttcaaggaaacctgtatttttatcttccgcatattttggaatctctgtaagcagatatccaaagtagtcatacggcttcaagttattcgccttggctggcaagacggatggaacttcgggttttggatgttcgctttgcagacgagacggagatggaacagctttactacaactacggcgaagcgcatctgctggatgacagtggaagaacttatgcccagataatccgaaccggaacgattctgatcaagtttgctttgtgccttgtacagagtgtatcaatagcctatatatgcctgctcagaaatatgaaagaaaaatcacttgcagtaatagcttgtgatggcaaggatactatgtctgtccgtgtacctgatggatttctgggattacatagaagttttaagatacacagtaagcaattcgtgtacgaaacactgatcggatggggattaaatccagaaaagacgtattcttttaaaggggagtatctggaggaacaaaaaatggtagtattttacctgaaaaatgattaaagattggaatatatagaagaaaatttattattagcatgaatgatgttggaatagtattgatgaattaatttgcctatgttaccatctaactatataaacagagacaaaatgatattaggggtggtaattatgagtttatttaatattccagacggtgtagatgttatagaagttagaaaaaaagtgaataaaatgctttctgaagcacgaaaaaaagcaaaatcaaaaaaatgtatattgtgtggaaaagaacaaagcagtttttgcaattctcattctgttccacaaatgtgtttacgtccgattgctgataagggaaaagttttacacgcatcattggcaatgggatttgatataggagtagtagatttggatggaggtgtaaataaatccggcacatttaattatatttgtagggaatgtgatgcgaaattctttcaggattatgaaaatccagataatataatacaaccgccaacagataaaattcttgcagaaattgcagtaaaaaatatgctgttacaattaaataaacgggatattgaactagagttgctggatattaagcaacaggagcttggaatatatgaaaatccagataagttatcagaattaaaaactttggatcaaaaagaatatcaagaagaagtattgtttcatcaggatatagcaaataataataaggaaggcggataccagattttgttttgggaggttctgccatataaagtaccaatagcaactcagagtgccatggtattaccatatgatatggaaggtgatatacttaatgacgtgggtaatatggataaatctgtgaggatgcaatatgttcatatagcggtattaccgttggagaaaaaaagtgttgtattggcattttatcataagagggataagatttatcgaagattacgacatcaaataaatactacttcacgggaaaaagtattacagtatataaattatttaatatttgagcatacagaaaatgtctatttttctaagacaatagaagaagaattaaaaaataataagatgattgaaaaagtgagtcaggaagcaaatgggcttcctacatttggacatttgagtgtcgataatatctttggaatggattatgaggctgtaaaaccagaagatatacctaattttttagatgaaagttgggctattaaagaagaggaaaatacggatggggaagaataacagcgtaaagaaaatagatgaagaacatattttgaagagatttgaatacactgttcgagaatatattagattttatgatttttacaagaatcaggaaatgagcgaagaaaatacagaagctttttatgttatgttgcagactaaattaatgattcttaggaaatacgattataatagggaagatgtatatttaagcaaggtatttgattccattgataagatgtatccagaattgaaggaaaatgttagtatgcttagagaacggtttgagaagcttaataattattatatggaagtaattttatccgatggaacgagtcttaatctttataaagctattgaggatgtgatgtatggtttatatttacacgcagatccagataaaatagaaagattgctcaaaacaaataaaaatgtatatcttatggctgtaaaagaatatattactgttttggaaggaatagttgttgatacatataattcaatagttgataaaatgcaaaataagtatatccagcaagaggaaacaagtgcatctgtaatttttatgggagatccaacaaatgaaaaacatgatataaaaaattcaccgtattggaagaatctatatggaagagatttggaagatacagaaataaaaggtatatttcaggatatgtctgatgaagatatagagatttatctgaaaggtactatattcctccaagagataagcaaggaaagttattcaatcaaattgttagaacaattagtgtttccaccaacaaggagtggctggggagatttctcgaacttgcatgattttgttataaataaaaagcatataggattaagtagtaggattaaatataatgatgaacataatattgcacatttgaagatatgtcaaaatgttgaaaatgcttttcttgtgaatcaaccacaccaagtacctgatatttgtacattaagttttgtgaaagaaaatgaaaaatatggatggagaatatttcaaattggagaacctgtgattaaatacaaagaatcaggaagtataatggactggataaaatatatcaaagaaaataaacgtaagagaaagtaaaatatgtgcggatacagtccttgtaataggggcgtattgatgttaagatggtagtatagaagatgtaaataagctgagaaaagaaggtgttaccaatgaatgaggaagaaagatttgattttgagcaaaagcacgaagaagaccttcaaagattacgtggctttcgtcttttagatgatgattttatgagcaaagtatttgaagataaggattgtgtggaatttttattgcagattatactaaaacgagatgatcttaaagttacaagtgtgagcagtcaatatgtaataaaaaatctacaagggcgttctgttcgtttggatattctcgcagtggatcgacaaaatcaggtgtataatattgaaattcaaagagatgataaaggtgcaggtgtgaagagagctagatataatagtagtttgattgatgcaaatgtaacagaaccgggtgaacaatatcaaaatttgaatgaaacgtatgtggtttttattacagaaaatgatgtgttaggagaaaatcttccgatatatcatgtggatcgtatcatcagggaaactggaaaaatgttcaatgaccaatcgcatattatatatgtaaactctcagataaaagatgaaacagcattaggaaaacttatgcatgattttacatgtaccaatgctaaagatatgtactatgaagtgttggctgaccgtgtacattattttaaagaagatgagaaaggagtggcaattatgtgtaaagctatggaagatatgagaaatgaagcagcaagagaagctgaaaaaatgaaagcaattcgtatggctcgtttaatgatagaagatggtaaacttagttatgaagatattgcaatgtacacagagcttactctggaagaagtagaaaaaatagctttggaaaagaaaagtgcataataaatgactcgaaacgaatgttctgtcttttggagcgataagtagaaaagggcttctgattatttataaaaatcagaggctctttttatgcctaaaagttgtttttgagttgacataaggaggcgatatgagcatcgtgggaacacgtcctctgttgattagagaagtttccaagtatgagctgcaccatcgggcacgacttgcgataaaatcgggaattaccagcatgtggcaggtaagtggaagaagtgatatcacggattttgaagaagtggtagagcttgataaagagtatatgccatctgggagcgggagcggcgcagagatgacctgtctaaggttcatcattcaatcattaaatgcagaagaactatttaatattaatacaatgcagtatgccgaagattccccatgatacatatatcaaatacgtttcatggggagttatttttatgcatttagattttcaagttcatgaatggacaagtcagtaaaatgagcaatttcttcaatggttagtttgccggaagatagcatacgcattgcagcttttacagctgtttcatgtgaactttccaacagcatcttttctatttcttcacacatggaaaacctccttttgctgattattcagcagattcttcagaagtagagctgttcttttttcgggactttccagaaatcattttgtgaccagaatagatagccataatcatgcagagaagagagctgcaagcaaaatatttatgtgcagatttcatatctttataaccagtgtaaaaagttccgatcatggttgctaatgcaccgagtgaccaatatttatgtaacttcatcttaatacctcctgtgctttttctatatcatacatctttttaagaaagatgcaaacaggaatttattcattggcttatatttaaaatgatatttttgtgacttgaaaaaaagatagagattaagggattataaatcctggttcttttcaatctgttgttcctgctcacgattcttctcaagaatcatatcaatattcgcagacacagtacgaagctcccgttcataattccggcggttagaaaaatcttcccgttgcatatctcgcaattcaataagtcggtctttttcagcatagagggctttcatggaaggtagcttatttccgacagatttttctttcagtgttcggagagctgtatcataaagagaaagctctgcccggtgttcttcgtagaatttatctttgttacggctcttacgataatcagcatacacatttttatatgccaggtattgtccggtaaaatgaatctgctcattcacatttctaagttgctgttctgtatcctttaaagattttctggaagcactggtctggtctgatgcctggtcaagtactgcatgaaaatcatcaagggagtcataaccatgttcctgtatgtaggcaacagtctgagctatctgcttcaaattggtgagctttactttttgagcataggcttcgcttggctgtgctttaatacaggtttgcagatctatgacaagtcggagatctgattttatgaaaatgaatggtgcagggatggcagaagtatcagagaaaggaacagttggtaaatctgtggaagtattcggagttggttgttccagaatttcttctttcagttctctatgggatttcgtgtttttctcaaatgctttcaagagaaaatcttctgtatatctggttccgagattcctttggagtgattccatatagcataaaagaaaaaagcgaaaaaatgttgaaaagaccgaattatctaactgttctggtagtgttaaaagtaatgatacgtcagattgacggagtttatcgtctggatcatgtttaatattatatgaaaaagtgtttggaatcatcttgataatatgttgaatacgacatattataattataaagaggaaggagcatactaatgtacaagatcattttatatgatacagaagatggaagatgccctgtgcaggaactattagattccctggagcctaagttgctggcaaaacattgcggacaattgacttactggaaatgaacggtccattacttcgtgagccatattcaaaaccattggagaatgggatatttgagtttcgtaccaagcagggatcagatattacaatagtactgtatttctttattataggcaagaaggcgatactgaccaatggatttataaaaaaatcgcagaagacaccaaaggcagaaaaagaactggcaaagaagtataaagcagattatgaacggaggtatggcaatgagtagctataaagattataaaaaaagagcattgcagaatccggaggtaaaggcagaatatgatgcattgcaaccggaatatgatattatccaggcgatgattgatgcaagagtgcagcagaatatgacacagaaagatttatcagctaaaaccggaattacgcaggcagatataagccggatcgagaatggaacaagaaatcccagcctgggtatggtgaaaaaacttgcacagggattagggatgcaattaaagctggaatttgttccaatgccaacaaaaaataaaatgtaaagagtatgagaaaataaaaaacgcaggaattttcacctgcggtttttctctgccctgccatatacagaaataccgccatagaaatattgctatactatgacggtattacaaatgcagtatataccaggtgaatattacattacccaaacttagtgatgaagaaatagctcagcaagataaaagagtgatacaggagttgataaatcaggcagagcatgtttacataggaaatagtgaacgagaaggtaaaaaaagtattggacataagatattatgtttttaaatgttatattatgaaaggattaaatttattgatggatttaggaaaacattgactggctggggtctgaatttggaaaagacttactcttttaaagggaaatatctggaagaacagaaaatgtttgtttttggtataaaggatgtagatttatagaagaatcattgttgaaatattttccttgtgataatataaatatagatgtatttagagtgatggaattacaaaattaaattgtacaaggagaacatttatgaacattcaggaattgacaagacagatgataatagatgaattactgatgattggctgtgtcgctggtcatatgggggttgctgaatttgtgcgaaaagtatatcctaaggcgaatagtttgcctacgacggatcacagatttggaatgacaacggctatagatgatattcggcaacacatggatcgaaataatgattggagttttgaggaacttttttattcatatcttgattttttgaaaattaatgatgaagactttaaatattttttgacacagtatgtgcatccatctattagaagatttcaaattaatgatgaatatgaaaaaatttcctttagcaattctgtttgtgctgaagcaataaacaaatatttaacttcagatggatatgaacttaaacaaatagacacaactgcaaatatgccaatatatagtgtggttcctttgactccaggagtaaatggaaagttgaaaaatattatttttgcttctaaatacaaaccagaaatcgttttgtcagatgctcttaataataatgtgactattgtaaataatgcagatcaatgtcttgtatatgatgaaccaatagggggacatggaattacatggaaagaacttcaagactggtatgataacgggttatatgagctggatatggtgacattcatgaaaaattcattgggggattccccaatggaaaaattgttttttgatacatatttagaaatggtagcagggagagaaggaaaaataccagcattgtttcctcaggtatggctgtattatgatccaaagttgcaaaaagatagaattaaaaagatttttgaacatcagcgtatggatttccttatgcttttttctgaatcacaaagagtggttattgagattgacggagtgcaacattatgcagaatatgttaaaggtaataaaaaacattatgcatcagttgataaatatgctgatatgatggcagcacaacgagaaatgagtttggctggctatgatgtttatagatttggagcaaaggaattatacaatcttactattggaaaaagaaaagtgtgtgcattttttgatagattattttctaaatatggtatatcagtataaagatggagatgtgtaatgacttttcaacagtggttcgataataattggcattctaattgttttacgattataacggaatagtatcaggaattatttcattagttgttttagcggcatattatcatttttgtatacagacacaagaaaggtattatcaatgaattaaaaattaaatgagaacgagttttgtcagaatcttatgaaaatgcttctaaagaaatactataagtatgaggggaaatttatagttgaaattgataaaaaagcagaggctgagtttgcttaaaggaagttaatcttaataaatgggcaatatagcattatgtgaatcaagaagaattaaaaaaataccatatcattgagaataaaaggtaaaagtagatgggaataagaataacgagtgcttcaacaccgataggcggaatttcttgggaatttacagaaacaaagaaaaaaggaatcaaagatttattcctttttcttgaatcaaaacgaattttggttaatccaaaagaaatggaggttaaggaatggagtgaacaatcagttatagaaataaaaaataaacttgtatctatagcaacagaatatgagtattctcaaaacacgatggaatgtttcaagatgatgatagacacctgtaatatttttttggataatatgcatcaagttaatatatcaggaatcatctataagaatcaaaaaggagattggattcatagtggctatgcttctgctatgaaggaatttcgtaaatcttttaaatataatatacaaagactttcagaggaatatcaattaactttttcaaaagaaataccagaagaatattgaatagtatctttgaaacggcggttagttgatgttaagatgataataaagagagaaggtgttaccgatgaatgaaaaaagtagtcttgatttcgaacagaaacatgagaaagaccttcatggattacgtggttttcggcttttagataatgattttataaaagaaagatgcacaggtggctctgaacagaaaaatgaattgccagaaaacagagaaaggatttttgtttaaaggaatgctttccatgggatttttttacggtttgttgcgtaccgcttactaagaaactccctacaatatacatcatatatcaaataggtcatgtgttgtagggagtcattttttgttatgccgttttctgtacagccagagccttgatttcttctaaggttaggtctgtaaaagcggcaatatcttcataagtgagtttgacggagaccagcatacgtttagcaatttcaatgcgttcagcttttcgcatattttccatttctctgcacatagtcaaaactccttcctcatcttctttaaaataacgtaccctgtcagcaagcattttataatacatatcttttggaacggtacaggaaaaatcgtacattagttttcttagttctgtttcatctttgatttgggaatttacataaataatatgagcttcatcgccaaatggttcaccggtttcttggatgatgcggtcaatatgataaattggaagcccggcttttaatacatcattttcagtaataaaaatcacataggtttcagtgagggcatcatatttatcgccagtttcagttatattggcatctataagactgctattatatcttgcacgttttgcaccggcaccacgatcacttctttggatttctatattataagttcggttattgttatcgacagctaatatatccaagcgaatagagcgtccttgtaaattttttatatcgtattgtccctgtgcagattgtactttaaggtcatgtctttgcaaaataacttgaagcagaaattccgcacatgccttatcttcaaaaactttactcataaaatcatcatctaaaagacggaatcctctaaggcgttgtaggtcttctttatgcttttgctcaaaattcagtgtttcttctgtattattcattgtaaaaacaccacctgctttcctttagaatggaatatagtaaacatgaatttctatatcattattttaacatggcaaatagtaatcctcaatacctgaattttgaaatgacaaatgtcgatgaaaaataacagcctatgacggtattacatatgcagtatataccaggtgaatattacattacccaaacaggcaggacaggagaatttagcctaattgttcgggtgaaatcctgcatttaggggatttattttcggaagttcacaaggcagaaaataatctgaaatttacaattctgtcgttgctaagcggtagaaaaagagctatacttaaattgagaaattatactcaaaggagatatgctctatgagtgaatataatatcgatattgccgatatgcagtgctgggtctttcggatggctcaatccaagtggaaaatgtctcccagcgattgcgcagagctgtttaagaaatacgacattctcggatttatcgccgactgctatgacattcttcatttgaatagctacgaatgtgctttgcatgatgttgaaaccctgctcaagaatcgaggtgttaccgtatgataggacttgaagatggaatgcttctctaccacggaaattatgtcagtattcctaacatcgacttaagtcgctgtatgggtggtctcgattttggtcgtggtttttatttaacctcatcttatgaacaggcatacaactatgtccagctttctgttcgcaaggcaaaacacatcggtgctgttccaaaaaactttgatccagctgacggacaaatatccgtctacaaatttcactatgatccaaacattctcgcttacttttttcaagaaaccagtattgaatggctacattttgtagcagccaatcgaaagaaagacctctttcctcagctcctgaaaaaatacagcgtaattgatatcatcggtggaaagattgccgacgatcagacagcccgtacccttcagatttatatcagcggtgaaggcgccggtgagcctggaacttcaaaagcagacaaagaaacgattgaaaaacttttaccaaaccgtctcgaggatcaattttgtttcagaactcaggatgccgtcgagcatcttgaatttataaggagtgaccgctatggcgacatcaaattgtgataatgctataaactataaatctacagattctcaaaaggaatgctgcgcagtaattgcgatgcgcgaagctgtagaaacttttgctgcacgagaaaagatttcttacgaggaagctcttcttcgtttcacaagttctcgtgtgtatgaagccctctttgattttgacacagagatttggaaagaaggctctgattatctgctgagtctttatgattattgcacttcaaaaaagactgcataaaagatatcatgttcgtaagcgatgaacatggaagcatattgctccataagccacatccacaaaaagaattaaaagcctatcaaatcaaacagctgatagagattttggaacaggtggtctcatatgaaaaacggaggaaagagagttatgttcgatatcattcatcatattgcaattattggaagcgattatgaaaaatcaaaacatttttatgtggatctgcttggatttaaggtaatcagagaaaattatcgaaaagaacgtgatgattacaagattgatctggcatgtggaccgcaggaaatagaacttttcatcataaaaaatgctccagctcgtgtaaattatccggaagcattgggattacgtcatctggcatttaaagtggagagtgtagctgatacagtaaaagaattgaatgggaaaggaattgaaacagagccggtacgactggatgattataccggaaagaaaatgacatttttccatgatccggatggacttccattggaaattcatgagtagaaaatagcatagaatagaaagagacagatgcaggtaatgaaatactcctacatctgtcttttttgtgcaaagatttatttatcggaatgtcgcaaacagctttttataaaaaataacaaaatgtaacgtcgataagaataaaagttgcagtttatttgctaaataaaaatttttattaaggaatggtaaaccttgcaggcagatgaatggtaagatataatcagtatatatttagacgaagaaggtgacgcagtgaaagtcgattttatagaattaacaaactttagaggtattcaaaaacaaagaatcacatttgaaaataaaaattttgttgcgttgataggagacaatggtagtggaaagacaaccatactcgaggcaattacaaagggatttgtacccatattaagaacagttaatgcagaagcaatgaaagagtgtgatttggcaaataatgatataaggaatggagctaatggagcagcagttactttagggataacgttagatggcgaaaaatatgtctggacaaatagacgtagattatcatcgcagcagccgtttgaaaatgcaggagatgtaaaagcggaaaatgcaaaatctttaaaagaattgaagtccaggtattcacaatgtgtggaagagagaaagctgccattgattctttattatggaacagacagaattatatgagaagtaccacagaggggacatataaaaaactttcaggtaacagatgctttaagaaactgttttgataatgtcaattattttagagacttttatgattggttcaagacagaagaggatattgaacttcgaggaatccgtgaaaatccagattataagaatccaaaattgaattgtgtaagaactgctttggaaagaatgataaagggatattccaatttaaggattgaattagcaccgtcaagaatggtaatgacaaattcagaaggggtagatctccagattgatcagttaagtggaggatataaagcagttttatcggttattgcggatattgcaaagagattatcaatggcaaatccagactcattgaatccattggaagaagaagctgtgattttgattgatgagcttgatttgcacttacatccaaagtggcagaaagaaatcgttgctgatttaaaaagaacatttcctaatagtcagtttattgtttctacacattctccatttatcgttcaatcattggatgctgacgaattatttgatattaaaataatgcagtatgcagaagaaggcaattacagaggatggagcatagaagctattcaggagcataagatgggtgtagaacctaaaaccactattttcaatcagtatttagaagaattttcagcagcaatggatgaggaggattatgaaaaagcaaaaatgctttacgaggagttaaaggaaatggtgagtccaggaagtaacgaaagtaagattttaaaactggatattaagattggtataataacaagactcccacatgattatttatattaagcatatttcatggggagtcatttttatgtatgcattccgattacataagcatagaagaaaaatttcgttatttttcagattgtgtagcagcttcttcagaaatagaatctttcttttttctggatttaccagaaatcattttatgaccggagtagatagccataatcatacagagaagagagctgcaagcaaaatatttgtgagcctttttcatgtttttatagccggtataaaaggttccaatcatcgttgtcaatgcaccaagtgaccaatatttatgtgctttcatttgaatacctcctgcgtttttctataataatacctctttttggaaaggatgaaaacaagaaatttataaattttattctttctcaatctgctgctcctgctcgtagctcttctgtattgaagcaaatgagaaaaatacgcctttgtgtattaacaggtttcctgctttcgtgtggaattgagataagtcagcttatcacccagcgagggtactgccaattagatgatgttgttacaaatacagcaggaacattaattggctggacaatttggaagggatttggtaaaataataaccataaaaaaacgaacgaggagagtatcaaaaaatgaaaacaacattagtaatcatggcagccggtatcggttcccgcttcggtggtggaatcaaacagcttgctccggtaggattaaatggagaaatcattatggattattccatccatgatgcaattgaagccggtttcaataaaatcgtatttatcattcgtaaggatatcgaggatgccttcaaagaagcaatcggtgaccgtatcgaggaaatctgcaaaaatttaaatgtagaaattgcttatgcatatcaggaattaaatgcacttccggagggagtagaacttccggcagaccgtaccaaaccttggggaaccggtcaggcggtacttgcctgcaaggatgtgctccatgagccgtttgcagttatcaatgcagatgattactatggaaaagaagcatttgtgaaattacatggcttcctggagaaatatacaccagagaaagcaaatgagttctgcatggcaggatttattttgaaaaataccttaagtgaaaatggtgcagtaaccagaggggtatgcgaggtaaacgaagaagggtatctgacaggggtagatgaaacttcaaatatcgtaaagacttctgagggcgcaggagtagataatgaggggacactcacaccaatcgatgcagaatcttatgtatccatgaatatgtggggcttaacacctgagtttatgcagacattggaagatggatttaaagagttctttgcgaatatgggagacaaaaatatcttaaaagcagaatatcttcttccgatttacatagatgaactgcttcaggcaggaaaagtatcggttaaggtgttagattctaatgataaatggtttggagtaacctacaaagaagataaagagtacgttgtaaaatcttttgcgaaactgattgaagatggcgtatatcaagaaaagctgtttgaagacctgaagtaggtggaacgattgaagaaatcctttaccagactggatgaaaattaaaagagattgatggaaaaattttgaaaatcaccacggcaggagtgtcgtggtgaaaatggaaaatgattagattaacattgattgtaaaaaagaaagcttgtacaagaaatagaaatcaattataataaaagaaaaatgagtgcagagaaagagaggtttgcttatgaattataaagagaaaaaacgttctatgtttttaggattgccatggacttttacttcgtatacgataacagatgagattataacagtggattcaggtctgcttcggaaagaagaaaatgattgctatctgtataaggtaattgatgtccgcttggaatgtactttaatggaaagaatttttggacttggaacggtccattgttttacgggtgatgtaacagacccggatttgaaattaattcatattaaacatgcaaaagaaatcaaggattatatattaagacagtcagagcaggaaaggctgaagagaaagactttaaatacgcagcatttggatggaaatccgagtctgggagagatggcagatacagatagctgtaagtaggaaaagagtaaagtgtgaaaatatgaaagtataataagttggaatcagaaaaataaaagagagccaggtgtcaggtgaaatctaagaagaaattcactccaaattcataaaagttaagttacaataaactcacaaaagcaatagagagggaaagtgaggaaaaagatatgacagtaattggtgaatttagatacgtgaatcattattttaaaatctacgaagatggagaaatttatgtggattataaacctttaggaaaagtatatgcagatggagatatctggattgcaagaaagagaatgggaaaaatctatgcagacggagaaatctggcttgcaaatgaaaaagtgggatgcctgacgccaaataaggaattgtgggtaaatggaagaagagtagcaactggagttggaagacctacaaattcaaaaagttcaggtaatacagcttctaaatcaaaaggaacgagtgaaaataaaacatatcaaactccaaaaccgcctgttacaacagaaacaggaattccagatatgtcaggagttgaaattgcagtttttttagttgctatttgtcttgcggtatcgattttgtatgcaacaactcagatatttttacatggaggactgcttggatctacttatagacagtatgccggtcagtcaaaattagttgatttattaatttatggaattccagcaggattttttgcacttgttacaggacttcagtgtgcatttaaccattcatttggtgtggttttaattgaacatgcagtttctgcatttttggaaatgtgtattttcagttgggtaacaggttatcctttactggctggtacagaatcgacaggattttatattttacttattttgatgcttttaatagcaagtttggcaccggcaacagtaagcacagtgattaagaaaattatttactggttaaaaaaataagaacggttttctatgctataattgcaaagcaattaaaattattatctggggaaggaatacaacatgggattaaaaggcttattacttggacatgaagtgaaggtttattatgaccgtcatttgacaaaaacagaaaaagcagaagatgcagagaatccaagtgaatatgaaattttaaaaggtgtggtgaacggcgtctataaggatatgattttaatttcctattcttatcgtgagaatgttcagacaaccaaaaagggactgttttcagaaaaagtgatagaggaagaaaaaacagtggaagcacattctctgattaatcgaaaatgtatcgtcagaatagatattcttgatttgaacctggaagaggaagaagaggagtacgatgaggaagaatatgacgaaggagagtatgaagaagactacaacgaaggggaagatttagaatatgacgaagcggattgcgaatgtccgctttacaaaaattaagattaacctttaagaaggacaaaaaattgcagaaaattttatgaaatggataaaacagagataaaaattgagacaatttagctgaaaaaacatccgaaaatactaattctggcatttcatgcgaaactatgatatactaaacaagacatggcgaaattcatggcgaaatgattatgaatataaactcataaaggagaatttatttatgtgcggaatagtaggatttaccggagaaaatcaggcagctccgattttacttgatggtctttcaaaactggaataccgtggctatgattcagccggaattgcagttcgtgatggagaaaaagagacagaagttattaaagcaaaaggtcgattaaaagttttggcggaaaaaaccaatggtggggcttctgtgccgggtacctgtggaatcggtcataccagatgggcgactcatggcgaaccatccgaaaacaatgcacatccgcatatcagcgatgatggaaacgtagtagcagttcataacggaattattgagaattatcaggaattaaaagataaattaacaagaaaagggtataccttttattctgcaacggacactgaagttgcagtcaaattagtggattattactataaaaaatatgaaggaactccggtggatgcgattaatcatgcgctgattcgtatccgtggttcttatgcacttgcaattatgtttcgggattatccggaagaaatctatgtggcaagaaaagacagcccgatgattctcggtgtggaaaatggggaatcttacattgcatctgatgttccggctatccttaagtacacaagaaacgtatactatattggaaatctggaaatggcccgtgtaagaaagggggaaatcaccttctataacttagacggagaagagattcagaaagagatgaaaaccatcgaatgggatgcggaagccgcagaaaaagccggttttgaacatttcatgatgaaggaaatccatgaacagccaaaagcagttttggataccttgaattctgtactgaaaaacggagcatttgatttatctgaagtcggtcttagtgatgaggatatggaaaaaatcagccagatttatattgtagcctgcggttctgcctatcatgtaggtatggttgcccagtacgtgattgaagatttggcaaagattccggttcgtgtggaactggcatctgaattccgttatcgtaaaccattgcttgataagaatgggcttgtcattgtagtcagccagtccggtgagaccgcagacagtctggcagcccttcgtgaagcaaaagaaaaaggaatccgtactcttggaattgtcaatgttgttggttcttcgattgcaagagaagcagataatgtgttctatacccttgcaggaccggaaatttctgttgcgaccacaaaggcatacagcacacagttaattgcttcttatgtactggcaattcagcttgcaaaagtaaagggacagattgatgaagaacagtatagtgcttatgttgaagaattaaaaacccttccggagaagattaagaaaattattgaagataaagaacggattcagtggtttgctgcaaagcaggcaaatgcaaaagatattttctttgtcggaagaggaattgattatgcaatctgtatggaaggcagtctgaaaatgaaagaaatcagctacattcattcagaagcctatgcagcaggagaattaaaacatggaactatttctctgattgaagatggcacattagtaatcggtgtactgacccagtctgaactgtatgaaaaaactatcagcaacatggtagaatgtaagagccgtggcgcttatctgatgggactgacaacttacggaaactacaatatcgaagataccgtaaattttgcaacttatattccaaaaacagatgaacattttgcaacttctttagcagtgattccattacagctgatgggatactatgtctctgtagcaaaaggtctggatgtcgataagccgagaaatcttgcaaagagtgtaacggtagagtaaaaatagaaaacaaatcatctggcagtgtaaaaagcactgtcagagttatcttaatcctgtttgagcaaaacacttttggcttgcttaaatatgattagattaacatttaagatgaggggacaatacgatgaaaaagaaaaaagaaaaatttagacagccaaaacaaaagaaacatcgaaatcatcacctgcgtttcctgacaaaactgattttattactgctttttgtggcagttggcatggggttttattacagttatcagttgttttttattccggttcatcaggaagtaaaaaatgaagataagggactgacaaaagaacaaaaagaagtaaaacaggaaagagaagaattagaaaaacaagagcaggaaaataagacttcgattgactatattgcagatggaagtcaggagaaagacgaatctgtcggaaaaatttcagatgaatctgacgcgctaaatgcattaaaggcactgcaaggagaacttggaattgcggatgtccaagaagaatatcggttttcagaagtgaaagaattagaagatttaaccgtttacgagatgcagcaatactatgaaggaattgaagtctatggacgaagtctgatggtaagtgtagatgaaagtggaaaccttcaaagcgtaaatggaacgtatgaacagccatctaatgtggcggtggaaccggagattcaggaatacgatgcccgagaggcagttgaagcgtatttaaaagaaaacgaagatacggacagctcagaagatccagaaagttcagaaagttcttattccctgcaaagtcaggggtatgtaatctgctttaatgaaaataatgtagccgaagcgggatacttgttctttgttgtaatgggatcgcaaaatactccggttcagcagatttttgtcagcggaaaaaccggagaaattttagcagataacagtctgattctgaccgagaaagtaagtggaacacttcagggacagaagtcttcacagacactcgattatgacaaacagggcgacgaatttaaactttgggatgaagaacgcaatattcaggtttatcgcacaacaagttccgaatttttgaatgtctatgtaaactgcgatgaaattcaatggaagacaggagaaactccggatgccggagcggttgatacgcttgcaaatctccaaaaagcgtatgattattataaagatacatttggaagagacggaattacaaatgataaaaatgttaagctggatgcaatcgttggaatacagaatgtaagggaaggaaatgaagtaactgattttagagataacgctgcaatgagtggaacagacactatgttgattggacaaaaaacagatggaagtgctacttatgcagctgaacttgatgttatgggacatgaatttaatcatggtgtggtaaacggtatatctacgcttttacagggagtttattcggataataatgcgagacagcgttcttctcagcttgcgatgggagaagggcttgcagatattttcggagaatttgtagaagattacagcgatgatgggaaatataatggctcttgcagttggacaaatcctgtcaggagcatgaacaatcgaacggatattttaaatcataatggaattttgcaggcaaaagactttcaggatggaacaaccgattgccatcagggagcaagtttaatttcctatcctacttatttgatggcaaccggagtagatggagacagcaaaaaagccatcagcgataccaaacagcttgcgagtatgtggtatactgtgatttctcagacttcaagtgcaaccggttttaaagaaatccggcaattaatggaaacccatgcgcttggacttgtatcaatgggtcatctgacgaatgatcaggtagagggggttatcgatgcctttgacgaagttgcaattgaaccgatgtatgattattgtctgaccgatgattccgaagtgattgtctatggggaaaataataagccctatgataattaccggattcaggtaaaccgaagattcggagaagaggtattaaacgaagaagtcaaaagcaagaaattaaatctgaaactggatgccggaatctataatgtggttttgacagacttaaataacgaagatttaaccaaagaatttactttgattgtaaatgatgcaaaaaaaggacagaatatttatcaaaaacaggcgaaggtcatgactcagtttggcgcaaatgttagagatgttgtgctcacactggatgtatcaggcagtatgggtggaactccgatagaagagacaaaagaagcagcgcagaaattcattgataccgtgtacgaaaaaagtccacagaccagaattagcatcattacttacagcagtgatgcgcaaaaggtagtcgattttacgaatgataaagcgaaattaaaaaatgcggtttccggaatttacagtggtggcggaaccaatatagaagcgggtcttaaaaaagcgtataagctaataaaagacgaagaatctttgaagaaaattgttgtcttgatgagtgatggagagccgacagaaggaaaacagaaagacggaagttatcgggaaccgattctcagtatggccaacaaaatgaaacaggataacctcatggtgtatacacttggatttttccataatttagagggagaaaatctgggagaatgcagacagttgatggcagatattgcgtcggaaggttatcattatgaagtcagcagtgctgattcgattcagtttgtctttgatgatattgcacaacaggttggcggtggagaatatgtttatattaagattgagtgtccggttgatgtaacagtgcaaaaaaatggtgaagtgttacggtcagaaaaagaaaatcaaaatatccgaacaggctttggaacattgtcctttgatggagaaaaagatgagattaagattctgagattgaaaaaagaccagaactatgaaatctgtatcaatggaaccggagaaggcgaaatggactacagtattggatttgtcgatgaagatggcacgtattcggatatgcgaaattttgaaaagattccggttacaaaagaaatgctggcagtaaccgataccaaagaaggcaaaaagacgactcttcaagtcgatgaaaacggcgatggacgttttgaaaaagtttacagtgcaaagaaaaactcgacagcagtagaagtttcaaaagaaaatcagaaaaaagtgctggtagcaataggaattgttgtacttttatggatgattttaaaagctcgtgcggtactgaaacgggcaaaatcaaatcgatactgtaaatactgtggtaataaaatcacaaaagaaatgaaattctgcggagaatgtggtagtccggttgagatacagccgttattctttgaaaaacatgcaaaagaatcaaaaggaaaacgaaaagtaaagcttgcattaataggacttttactgttattctgtgtatcggaaacgatgatttatcagacggcttcaacgaaagtttatcgctatgtgtgccggggaaattatacactggcagagaaaatgtatgatggaaatgtaaaaggtcataagatttcccaaaactatctgaacaatctgcttacctatcatgaaaaacgtgtaaaaacagcgtatcaggcaggtacagtaaatgaaacttatcttacagaaattcaggagattgtaaagaaattaaagtagaaaaaatttaaattaaaagacttaaattaaaagatttaaattaaaagacttgaattaaaaggcttaaataaaaaaagacggaaaaaaggagacgaaaatgtacgattatctggtagtaggttcaggtttatacggagcaatttttgctcatgaagcaaaggcatcaggaaaatccgtgcttgtggtggaaaaacgcccgaatattgcagggaatgtttatacagaaaaaagggaagggattcaggttcaccggtatggtgcacatattttccatactaataataaaaaagtctgggactacataaccggatttgctgaatttaaccgttttacgaacagtccggtggcaaattataagggagaattgtattctcttccatttaatatgtatacctttaataagatgtggggagtggtaaccccggaagaagcgcaggcaaaaattgaagaacagcgaaaagaaatcattggagaaccaaaaaatctcgaagaacaggcgatttctttagtcggacgtgacatctatgaaaaattgattaaaggctatactgaaaaacaatggggacgagactgcaaagacctgccggcatttattattaagcgtctgccggtgcgcctgacttttgataataattattttaatgcactctatcagggaatcccaatgggaggatacacaaaaatggtagaaaatttactagagggcattgaagtacgcttaaatacagattatcttgaaaacaaaaaagaactggatgcgcttgccaaaaaagtggtttataccggtccgattgatgcctattttgattatgaactgggatatctggaataccgcagtgtacgctttgaaacggaaacgctggataaaccgaattttcagggaaatgcggcagtaaattacaccgataaagagacaccatggacccgtattatcgagcataaatggtttgaatttggaaaagatgaaaatggggaagagcttccgaaaaccattatcagccgagaatattcttctgaatggaaaccgggagaggaaccttactatccggtaaataatgaaaaaaatgtagcactctatgccagatataaagagatggcagaaaaagaaaataaggtaatttttggcggacgactcggagaatataaatattatgatatggaccaggtgattctggcggcgcttgaacggtgtgaaaaagaatttaaccaaatcaagtaagtcccctgcttcaattgcaaaaagcaataagcagcggattgcgaagatccgcctaaggaatagaggaaaaataatgggaagaccaagaaaaaatccggagtacaatccggaagaacagtttcaaaaaatgctggaggacgtaaaaggtgcttatgagaatgcagattccctgcgttctctggcatcagaattaaatatgacattgttaaagcttcggaaattactgattacagcaggcatttttacttcggatatctgtatggaggtgaatcaactgcatgaacagggaaagacgattccggagattatgaaaattacaggactctcaagagcttctgttcattcttatctgccttatgtcaggggaatttataatacagaagaattaagtctggatgcaaagcgctgtcggatgtatcgcgaacggatggaacgtgtaagaaatctgcagttaaatccaattccaaaaagattatgggaaacgttagtgatctttgaagattatccatttcgaagagagacaaatgagttgttccgctatcaggtatctgaagcaggtaaaaatccgaagaaactgtttttcaaaaacggagagcatgagtgggtgctggaatggagagaaatccgtaaaagcttaaaagaaggaacagaaaacctttatattaaggcaattttcagcagatttggtttggaagatatggattagaagatatgaataaatagaatgtgctttaccgtaaaaacgatttatctaatattttttttaattgttcagattttattgttttttaaaaagcagtgtgctatcatgattaattgatatagaattagtatgtagaacaggatgaattatgcccttggtgcaatagtaaccattaccgtaaatagaacagatggtacgaaattacagatgataatggtgtgggagatatttcagcggctgactatcggtcaaaattacactatttaaagtagtaacaaaagaataagcagaggggatgagtaaataggagatatttatttattcccttttttgattttatgaaggaatttgagagttagagattttttcctggagttaaaaagagaaacggaaagataaaaggaggtgacagcccatgtccatggagactctgaatgttatccagtttatagaacttttaataggatttcttggatttacagttggattacctgctcttgttttttataaaaaagtgaagcattttcaggcgtcggttcgttttttgatttattttgttataggaaatttttatattatcaatttagttcaggtgttggaactcgtatatgtttcgtatcgaattacattaatattgtttacaatacttccggttataattgcagttataaaaatttacaaaattccagtctggtcttatataaagaaaataggaagcgagctttatcattatattttgcgggaattaggctttcgtagttttttaagacacagactgaaagaagtgtgtaaagctttcaaatttttgcttcgtcaggcggtgcgtttattaaaagagctatggctggaccttccgtttttatgtattttgatttatcttatctggaaaatctgtggagacggaattttaaataactgggggtatggtgcttctgatgttccggtgcataactactggattaatggattagttgaaaataaattatatattgccggaatttacccaatggggatgcactgtatgttgtattatctggcaactgttttaaatattcctgtttatgtgacgctgcgtttgttctggctggttcagtacagcatgattgtatttatgttgttattgtttttaaaaggatgctgtaaaacaaaatttctcccgtatttgggagcgattggctttgtgggattaaaatatttcatggaaatttcttactcccgatttgaggcaacacttccacaggaatttggaatgctgtatattcttcctgcgatttatttcttgctggaatattttaaaaccagaaaagcggaattagagaatggagaaaataaaatccgatgctgttcctcctggaatctgcttggtttttcaatgagtttttctctgacgttatcgtcgcacttttatgactccattattgtcggaattatctgcgtgggaattgcaattggatatagtgcgtggatttggagaagaggatatttgttccgaattatagtttccggagtgattggagtgttaatggcactgcttccgatggcagttgcgtttttgacagggaaagaacttcagggttcaatgtactgggcgatgagtattatagggttgaaagactataccgttctagtatttagaatcatttgttttgctgtagttgcaacaacaattgtgagtatcgtttttttaattaggggaattaaaaaaaagacaatttcttttacggaaaacagaccaatccatacagaggcaaaagtgcttttaattatttttaaattatttggagtattgcttttagcagttctgttgtttcttggatggagagaaaaagaaattgttttttggggactcagccagtatgtatttgatttaaccgattttaattggatgctatatgcggttggaattgcagtgatagttggaattacagtgctagttggaattgtacagagttattttatgaaaaatatggaaggtgctgctctcttatctctgttatcagcagaagtgatgctgggaataattctggtaagtgataagttaggtttgccggttttaatggaaaattatagagtttgtgtctatttttcttatttaattccagctgtatttattttggcattggacaatttgataggaattttgtgttttaaccgttttataaaaattcaaaaagtaatagcatttggtatggtgattattttattaggatatagtacaaaagagggatggatgaaaaagtcttttggtggtggagatttggaaatgaatgaagcgattctttgtaccacgaatattttaaaagataataaagggaaaaatgatacttggaccattgtttcagaaaatgatgaattgcaaatgatagaactttatggacgtcataaggaaaccattacttttttggaacagatggaacactggaatcagacaaaggaaattctgatacctacagaaagggtttatttttatatagagaaaaaaccattaaattatgcagatgagtatgaaggaaaaattccggaaatctcagaaaaacaggctcagaaagcacttccagaaagtacaggaatgaatgcttataggggtaaaaatcgttccgttacgatgtcgagaatgtactactgggcacaggaatttcagaaactctatccaaatgaattcaaggtttattttgaggatgaaaattttgtctgttactatatagaacagaatgtctatcgcctgtataattttgcaattgattatagatataattaaaaaattcacagataaaggggtaaaaataaaaaaacaaaagaaaatggagtaaagaatggatattatgcttgttggtggagcttcaccactgatgaaaaaactttctttaaaattacataaagagggacatcggatttttgttttatcgggaagccgagacccgcagaatcattatgaacatgtatttgagcgttatgatttttcttatgacaaagcatccgtagaagaggtgtttcgcagtgtaaatccagatgtgacaattttgatgggagcttatgactcaaattatccaggaagggattttagaagagaagctgtagcgtattcggcaggacttcagaatcttttgctttcgtggtctgccttaaaaaaaggcagattgatttatctttcttccgtagaagtttatggagggaaatatccaagtgccgtttccgaacaggataagccaagaccgagaggcgttcgaccgcgtatgctctatcagggagaagaaagctgtcgtttttatcaggaagaactgtcaatggatgttgtaattttgcgactggactggctgcatgacgtttgctgtagtacgaaagaggcattaagcagtatctgtggaagaaaatgtctggatgcgtttcgagatggttctgtttcttatcaaagaaattatgcctatgcgctgacttatataggagatgcagtagagagtatttataaagttgtggcatgtgaagaacatcaggaagcgctgtatcatatttcttcatcggaggcatactcagaacatgatattgtaaaaaaagtcggggaagtgcttggaaagaagatagaacagattgataatatcgtgggagagcagcatcagattattttatccaatgaacgttttaaggctgagtttggatttaaggtctggtgcagaccggaagagacaatagaaaaaacgcttcagtatatgaaacagcacagtaataaattcttagatgcagaccatcccggaatggatatctggcataaattgtattatgccatgacaagtacactgggagcattggttccgtatcttgaaaatctaatcttatttattccgttttttatgttaaataatcgtgcaacggacagtcagtatttttcgaagattgatttttatttgttatatgtattgttatttgcggttatatacggacagcgtcaggcaaccttttccggaattttggcaactgcaggttatctgtttcggcagatgtatacccgctccggacttgcggttgtaacggattataatacttatgtatggattgcggaaatttttattgtcggtttagtcgttggatatatgaaagacagcctgctgtttttaaaagaagaaaaagaatgggaagttggttttttatcggaacaggttacggatatcggtgacattaatgacagtaatctcagggtaaaagagggattaattgaccaggtgattaattatgataacagtctgggtacggtatatgatgcaacagaacagctggaacagaaacagtcggttgaaattttcttttgtgcgttaaatatgattcagaagctgatggattgtccggatgttgcaatttatcgtgttaacaaagaaaagtatgcgaggctctttgcttatagttctgcaaaagcagcttctatgggaaataccgtctatttgccggataagaaatctctggacgaggcatgtaatgagaacagggtttacattaaccgttccatggaaaaggagtatccaatgatggcatataatgtggaatcagaagaacagatggagattctgattatgttatggagtcttccttttgaacgaatgaccatcaatgaagcaaacaggctgattgtaatcggaaagctgattcaaacttctgtcagaagagcggaccgttatctggaagcgttgtcagaagaacgttatcatagcgaaagtcagatcttgaaagcttcagcttttgaggaattagtaggagcatatcgaaaggcaagtaaagaaaaactgacagaatatgtactgcttcagattgaagtggagggcgaaaatgaaaaagaaactgtggataaatttacttcgatgcttcgagaatctgattatattggaaatctttcggatggaaagttgtacttgttattaacaaataccgatttgaaaggctgtagttttgtacaaaataagttaaaacaaaacggagttgcctccagcatcagcgaggagggaagactatgatgcactccgggtattggtttcttattttgttgattttaaatacgttaactgcattgctttatttaatctggtatctggtttttaaacaggataaagataaccgaattcagtatatcatgcatacaatcgtgatgatactttgtcctttagtgggtccgttgtattttctgcttggatttttaaagtatcattttatgaaattgggagaaagagatttatcagatgtagagtttgcaaaaaaaagacatgtttcccgtgtaaaagcagatgaggaaagagagcgaaatattgtgccgattgaagaggctatttccatttcagatcaggagaaaaaacgagaaaatatgttgaatgttttattaggggaaacagataattctctggcctctatttcagttgctttagacagtgatgactctgaggtggcgcattatgcggcatctttcctgcaaagtaaaatggatgaattcagagagcatgtaagacaggcaaaattaagtatttcatcaaaggatataaaagacgaggaatgtcaggaagaaataaaaattttgattggatacatgaatcatacgctgaagcagaatattttgacgagcatagaacaggaagattatgtgcatcagatggaagcattatgtgaacagctctatgaaaatgcaagggaaaagttagaagtaactgattatagttttctgcttcaaagattaattgaacagaaattttatgaagaagctgagaagtgggcagaacggtttatgacacagtatccggatgaattgaaaccgtatacgctgtgtatgaaattatattttgaaatggaacaaaaagaaaaattctttgaagtattggacaaattacgggcttcttcgattgtcattgacaatcagacactggaattaattcgtatcgtacaaaggtaaagaaaaaggaggaaaagaaatgctttcaaaacgaaattttggaatgatgatgacgattatcctggtaatattaatccttttcctctcatcggcggtattaagagagtattttaatgattataatgagaatcattcggcagattctgaatgggtaaaacggtcagaagaaaccaaagaaaccaaggacagcaaaaacagcgaaaaaaactggcatatcatttatatcggaaaacaggatacaggatattatgagtccattcaggagtggtgtacgtatcgaaaagcagaatttgaagaatattctgaaacaaaaaaagcattaaaaaaagcagaggcttatgaaaaaaaaaatacgtatcttttaattagtggcagtgttctcgagaaagatacagaaacagtttccgatagtttgacttcttatgtggaagcaggtggaaaaataattttttgttctcttccggattatttggtgattgcaaaatcagaaacgttaaaaaatcttttagggattcagcagttaagagcaaaaacggtaacgctccaggaaatctggctgtatggtggatttttgcttggcggagaaacctgttattcctttgatgaacttcaagatccagacagaattgatatggaacgagagattccatggtatgatatttcttcccggaccaaaacatatatggtgggctttatcaaagcagaagagcagacaaagcaggagcttcataatgaagacatgccggcaattatctggcggtgtaacacaggagaaggttcgatttttgcagtaaatggcgattatatggagggaaaatcgacattgggaatattagatgccatggtttatgaatcacagaattatgcactttataatgtggtcaatgcgcaaaatctttcgcttaccggctttccggatttaaccaaagaaaatgaaaaaaaatttacagaagtatatggatttgattcaaaacagttttgtcagaacattgtctggcctgctttgatatctgtagctcaagatggagattggaagataaccgcttatctggcaactaaacaggataatgattccaaagaagatgcggatgtaaaatccctggttgattatttgaaatattttaatgaagaatcggcagaagcgggaatatcgcttggaaggatgaatgatacagatattcaaaaatcactggaagcagataaacaggaaatagaaaaacaggatattacgtatccattttcgggggcttacattcgaagtgaaaatgaagaacagttatcaaagttggtaaaagatgaaaaattaaaaatattttcagatgttcgtacgatttgtaaagcgtacgatgaagaacagccggttttttcctggatgacagactggattacaacacaggcaattacaatgaatgggtatcaatatacgtataaagatgactttcgtttaaaaagcattcagaccgcattaggttattctaatgtacaggcagatatatatcgtgcgatttggcctcaaaagagaaaagatgagtgggaagtaatttctgaaaaattagcctctaatattagcacgtactggaacccattttctgtatttgaaaagacaacaattacagagagtgacaccagagtccgcagatttttaaatgaaagtgtgacaagcgataggaaagcagaccaaatttctataaaagtagagaattttaatgaggatgcctggatgatgctgcggacacatggagaaaaaatagaatccatgaagaatggaagctgggaaaaaatagaagatgatgcctatttactgcatcttacttcaagtcaggcaacggtaacactgaaatcggatacagaactttattacagtaaaaaataaaggagataaacaatgcgaatctgttttattgcagaaggatgttacccttatgtggtaggcggggtatcaagctgggtacacagtatgataaaaaattttccaaatcaggaatttatcctgctcacgattgtagcaaatcgggaggcaagtggaaagtttgcttatgaactgccggagaatgtaacggaggtttatgaggtttatttggaagatgtggattggggaagtgtcaataaacataataaaacaagattaagtgaaaaggaatatcatgcacttagaagtctgattttgaatcatgaagtagaatgggacaatatttttgaattttttcataaaaagaatatttccttgaatcagcttctcatgggagaagacttttatcatgcagtgttagatgcgtacaatcttcagtatccggagattgtattttcagattttttatggacgatgcgttcgatgtatcttccgttattcttttgcctgatggcagaaatccccaaagcggatgtgtatcatgcggtggcaaccggatatgcaggggttcttggaagtatgggaaaatattttcattcaggtcagcttattatttcagaacatggaatctataccagagaacgagaagaagaactgataaaagcagaatgggtacagaaagtttataaaaaaatctggattcagcagtttcgcaagatgtcaaaagtttcctatgagagagcagatattgtgacaagtctttatcagcatgcacaggaattacagattgaacttggttgtccaaaggaaaaaacaattgtgacaccaaatggaattaattatgagcggtttaaagaattaccacagtgtccgccggagcaaaaagagtatattcatattggagcggtacttcgagtgactccgattaaagatgtaaaaacgatgattcaggcatttggatatgcaaaaaagagagagccaaaactaaaactatggattatgggaccatataatgaagacccggattatgcggcagagtgttttcggatggtagagacaatgaagatacaggacgtagagtttacgggaaggatacaggttacagattacttaggctggatggatgttactattcttaccagtatcagtgaaggacagccgcttacgatattagaaagttatgcagcccatgttccggtgattgccacagacgtcggaaactgcaggggattaattgagggagaagaggatgattttggaagggcaggaatcattacccatatcatgaatgtaggagaaattgcggaagccatggtgtatatggcaagaaatccggaagaaagaaaggcaatgggagaagctggttataaacggctgatgaaacgatataaaatcgaagatatgaaacaaaaatatgaagaaatttataaagagtgtgccgaacgccggaacttagaatgggaagaataacttttaagatttgagagtacatacagaaaaaaggagaaaacaatggcaggaataggagtaaagttaaaccgtatttatcaaaaaaatacgattacaacaaatattgtgggatttttctatagtatgactatgacaattgcaccggtattagttgtaattattaacctgatgctgatgcaaaaagtgttaaaatttaatactgttcgttatattgatcgtgaattgttttcctgtacggtgctttatgtttttattttctctctgcttacaacttcgccatttaatgcggtattatccagatatatgtcagatgcaatctttgaagaacggtatgaagatgtgcttccatgccatcgaatcggtctgttgatcaatatctgttttagctgtctgtttgcaattccgttttgtttgtgggaacatttcgttggaaaagtgccggtgtattatgtgtttacaggatattgctgttttgtttctctggtgcttgtcttttataatatgttatatttgtctatttgtaaggagtatcgattgatttctttgcattttgcacttggaatgattgtttcttttttgttatctttattctttcgatatatctgtaaaatgagtattccttatagtatgcttttgtcacttgcaattggattttttgtgaccgcagtgtttgaatgggcaaaagttcatcagttttttccggataacagtgaagaatacaggcgggtattcgtctattttaagcggtactggcatttgattttaatcaattttttatataccctgggattgtttattcataattttgtgttttggggaaccgatatggcaatgcatctggtaaaaacatttgtatgtaatcagccttatgatatggcaacctgccttgcaatgtttacgaatttatcggcgagcgttatctttatatcaagggtagagatgtatttccatgagcgttataaagcgtatgctgacgcagtgttcggagggcgtggtcttgatattcaaaatacaagaaagcgaatgtttcgccagcttggcagtgaactgatgaccttgattcgactgcagtttattatttcagttgttatttatctgatttttgtaatctttcttccgagaatgggatatgcaggattggttatgcgaatttatccgatggtagcagcaggatatttcattttatttttaatgtattcagaaatcattttcttatattattttgaagatttacagggcgcattggttacggcacttagtttttgcggagtaacgtttcttgcaagtttaattgcggttcatcttccggcagttttttttggagttggaatctggacaggttcagtagtaggatttaccgttgcttatatgagactgcgttggatggaaacacatattgacgagcatatgttttgcaggggaaatctgataaaaagaggaaaaggaattaaaccatctgcaaaagtgtttgatatacgagaattaaaaaaagagccggaggatgaagaatgagatgaaaaaaatattatttgtgattaacacgatgggctatggaggtgcagagagggcattattaaacctgatgtctgcacttgaaaaagaacagtatgagatttctgtatttgtacttacaggtcagggagaactgattcatcagataccggattcggtgacactcttaaacaaaaattataaagatgtctctgttttgacctcgaaaggtcgtatggaattaatgaaaacgattttaagagctggaatcttaaaaggagcattttttcgcaggttttcttatctgataaaaaatagtgtaaacatgaaacagcaggggcgttttttaccagataaacttttgtggagaatattagcggacggagcaccgatgatgcccaaagaatatgatttagcagttgcatatttagaaggcggagcgacgtactatgtggcagacagagtgaaagcaaagaagaaagcagcgtttatacatattgattataagaaagccggatatggcgaaaaactggatttgggctgttatgaaaagatagaccgtatttttacggtatcagatgaagtgaaagaacattttttaggggtttatcccaaatatcaaaataaggtgtcagtttttcataatctgttagatatggataatgtaagaacaatggcagaaaagccaggaggatttcaggataattttaaggggattcgacttttgacagtaggaaggcttgtagcacagaaaagatacgatatggtgattcaaacaatgaaacttttgaaacaagagagtaagaaacccattcgatggtatatcatgggagagggagaacttcgtacaaaattggaacagcagatttcagagaatcagttaacggaggatgtgattcttttaggagtaaaagaaaatccgtttccttattataagcagtgtgatatttatgttcatgcaaccggatacgagggcaaaagtattgcgattcaggaagcacagattctaaaaaagccgattctggcaacggactgcagcggaaatcgggaacagattgagcagggaatagatggaagattatgtacacttacaccagaaagtattggtgatgaaattctatggatgatagaacatccaaaggaatgtcaaagttatggagaaaaggcagagaaaaaagtattacagagtaataaaggattggatgaatttttaaattggatgaagtagttttggttatttacgaatgagggaaaaagatgaggacattagtgttaataccagcatacaatgaggaaaaaaatttagaacgagtgatagaaaatttaaagaaaaaagctccacagtttgattatatcattataaatgatgggtcgacagaccatacagaagaattatgcagaaaaaaacagtatcattatatcagtcttcctgtaaatttaggattgaccggagcaatgcagacagggatgaagtatgcaaaagaaaagaactatgatatggcaattcagtttgatgcggatggacagcatttgccggaatacatacaaaaaatggtggactgcatggagaaaacaaactgcgatgttgtgattgcatcgaggttctatggaggaaaaatgccgcttcgaatgagaacagccggtgcaagattgattacagctgctattcgcctgacaacaaaaaaatatatttccgacccgacaagcggaatgaggctgtataatagaaccataatagaacagtttgtaaaagatgcaaataattctccggaaccggatacactttcttacttaatcaggcttggcgcagatgtcagagaagtgagagtaaaaatggcagaacgaacagaaggaaaaagttatttaacaccggttaatgcatcgaaatatatgatgcagatgctgatgtcaatttgcatctttcagtggtttcgggatagaaaggcggtattataagatgggaattttaagctggaagtttcgaattgtattgtttttgggaagcgttgttgtgtttttattgattgcccgtttcgtaagaaaacagagaattcaagtgaaagatggaattttttggattttatttagtgttatattaattatattttcaatttttccaaggcttgcgatatgggcttcttatttaaccggagtacagtcaccggcaaactgtgtttttatgcttattatttttacattaggatgtcaccagttctttttatcaattaaagtttctcagcttaccatcaaaaacagtgagctgatacaggacattgcaatttatcggacattagaaggtgaggagaagagagcaaatggagaggaaaattcataaaaaaaagatttgctttttttcaggagacattacaagaagtggtggaacggaaagggtatcggtacagcttgcaaatgaactggcgaaagaaaaagaatatgaaatctgttttttaagcctggtagaacaggcagacaagcctttttatgaaataacgaatgatataaaaagatattctcttggaacacactggattaatccgggacctggatatctgcctttgattggaaagttaaaaagatttttaaaagcacaggaaatagatattataatagatattgatattgtgttggatgtactgtcgattcctgctgcaaaaagattgaagacaaaagtgatttcatgggaacattttaactgcgaatttgaacagagtgtgctgtatcgaaaatggatttcaagattgtcggcaaagaaagcagattatattgtaacgcttacagagcaggataaacagagttatggaaaacttctaaaaagaacttcagatattgaaactgtctataatcctttttctcaggtggaattaaatgaaaatataagacgggaaaactggattgtgacagtaggaagattaacctatcaaaaaggaacagattatttggcagaagtagcaaaagaggtattaaaacaaaataaagactggaaatggattgttttgggagatggggaagaaagaaaaaaacttgaaaccataactaaagagaatgatttagaaaaacaattgtttttaaaaggtagagtagaaaatgtagaatggtatttaaatcgtgcaaaattatttgttttgacatcaagatatgaaggacttccattatgtttgattgaagcaatgcagatgaatgttccttgtgtgagttttgatgttaaaacaggaccttcggatattatagaaaacaatgtaaatggaattttgatttcaagttttgaaattgaaaaaatgataaaagaaattaatgctcttttaaaagataaatgtagacttcaaagtatgtctaagaatacaagagataattttgaacgttttaaaatggaaaatattattaaaaaatggaaaaatatatttgaaagattagaaaaatagaggaaaagaaaatggcacaggtaagtattattgtaccggtatatcaggtagaaaaatatatccgaaaatgtattgaaagtatacaggcacagacattttctgattttgaattgattttagtggatgatggctcaaaggatgcatctggaaaaatttgtgatgaatacgccaagaaagatgataggataaaagtaattcataagaagaatgaaggagtagctctggcaagaaatgatgggattaaactttcaaaaggaaaatatgtctgttttatagatggagatgattggattgaaaagtttatgattgaaaactgcatgaatagaatcttagatacagaagcagatgtgatttttcatggttataaacaagaactatggaaaaataaagttgtaataaatatagaagaaaaaagtacttcggattttttggatactttaacgcatagtgaaatgtctgaaaaaatggaaatgctttggccatattgtagtagctatgtatggaattatttttttaccagaaaaataattaaagaggagcgttttccaaatgtaaagatttcagaggaccatatatttatattaaatgtattaaaaaaatgtgataaaatttcttttttaaatgatttttcttatcattactgtatgagaatgggttcttctgcaaatagatggaatgatacaggattgttttgtcaaataaagatgatagaaacttgtcatgagtttatggaatcctttagtatttctgaacaaaggaaaaaaaagttgatggcgcagataactttaagcgcttattcttatgcaatttatacattttgttttccagaatgtaaaatttcagtaaaagagaaaatgagacaattaaaaaaaatgaagaagcagttaaatctaaatgaatttattccttatgtagaaatgaaaggtttgtcgttttctgaaaaaataaaaaccaagatgatttgtaacaaaatggaaatattattagttttagcaggtccgatatttatgaaagtagtgcgcagggcataaagttaataataatagaacagaaatataggattattgaaattgaaggagattattcaaatgaagaaaatttgtgttattatgggcggagttctgccagttcggattaaatgcaatttctgtgcgtgaaaaaagttcaattcctattttacaagaaatgaccaataagccaatacaggtagtagtagaccctgtactgttattacaaaaaaaagaatgggagcaagttgcacgagttccgcaaataaaacaactatacttagtatgctatttattggaagataatatagcacaaagaaaagcagtggaaaaattagcaaagcgattaaagttaaaaatattaacatttccacacattttgtgtaatgtagttcgaaaatgcgatttgttttttggtgacattcatgattatacttccggtcctcgtgagtttatcgggttaattcaaaatgccgagcttatagttacagattcttttcatgcatcagttttttcgatgatatttgaaacactgttttatgtttttaaacgagataaggcagatgcaaaaaacagtaccaatcgacgaatttatgatttcttaaaagagtatcagttagtatcagaagagagtttggcagaggtaaataagattccagaagttgattttaaatatgctcatcagcattgggaaaaaagacgagaagaatctttggaatatctggaacatgcattaggagttaagaggagaaaacacaggtgaaaaatcaattaaaggcgggagttattttttcttatatatcaacaggaattacagtactcatacaattaatttacttaccgattatgattcggatattaggacaaagtgaatatggtctttattccgtggtatcaggggtagttagttatctgagtttgttcagtcttggattttcaggggcatatttaaggtttttttcaagatttaaataccaggatgataaaaagaagcttgcttctttaaatggaatgtttattatacttttttgtgttttggcattcattgcacttgtttctggaattattcttagcttttttcctcgtcagatttttggctctaaattatcagatgctgagctgataaaagcaagaatattgatggcgatattggtttttagcatggcaatagtacttgttagtagtatttttgaagcaatcacaagagcatatgagcaatatatatttcagcaggctgtttatttaatggtagtagtagttaatccgtttttatgtttgcctttacttttaatgggatatagaagtgttatgcttgtgcttgttggagcagtgattagtatagggcggctggttgctaatgtttggttttgtgtgtttaaactgaagattccgatctcttttcacaactttgaatttaaattgctaaaggaaattagtgcatttagcttttttttattgttaaacatgttgattgaacaagttaattggaatgtggataaattaattttaagtcatacaagcggaacaaaagaagttgcggtttacggtgtggcatcacagattaatgggttatttattaacttttccacgactgtttcatctgtgttttcgcctaaaattaatcggattgtggcagaagagagagaaaattatcaaaagaaatttacaaaattaatggttaagataggcagaattcaatggttgttattgggaatgcttacaacaggatttattatatttggaaaatattttattgtacatatttatgccggtaaaggatatgagaaatcctatatcacttcattatgtctggtgataccggcactcatacaattaattcaaaatgttggagttgaaatgcaacgagcgttaaataaacatcagttttgctcaattatttattttgtaatggcaatcataaatgtagctattagtattccgttggcaaataaatttggagctgtcggtgcagcgatgggaacaatgattagtttagtaatatcagatgggataattatgaatgtattctatcataaaattctgaaaatcaatattaaattattttggaaagagattatgagtacattaaaaggatttgcagttccagtgatatcaggaatactgattatgaaatacataaaatttagcagtattatggaatatttagtagttggtggagtatatgtagttgtttacagtatatctatttggaagatgagttgtaatgaagaagaaagaaaaatggttttaggattaataaataaattttaaatgcagatttacgatgctgaaattgaaaggaagattgatgaaagaagaaaatggaagaatggattaatactccattcttcccagcaacagtccttcttcttgtatgccctgcgtatttgcaagtgaaatttgtttttcactttgtgcatccgtaatagaaagaaaaacctgataagaaccggacttaagactttttcgtggtagagagaccgaaagagtctttttttgtgtactttttagtttacgaaggtcgtagtcaattggaacagaagagatttctcctgtttctgtatttttaaacttcagtgtagcatgaaattcttttaaggtgtttccaaatccggtattttgaagtccaatggagagatttagctgagagtttaaaaatccggaagatttcattgtgcattttgtaaccagataccggtagccaaggtgtgcctgaatataggtatagccatcacatccataaaaggcatcgttttgattccaggttgtatttttccacttatcgagtacggtgttgtcatagtctgcatttaaataggaaacatgcatggtggttaaagactcaactgcagaaggtaaatcattataagagttgtcggaaaccacttctccgccatttggaacatactggcataacgtgttttgaaattttaattcgtcttctcttgtacctttataggacggagaagtggcatcttttctttttgtatcgccataagtgccaaggtcagacacagatcctaacattccatcattgtaaagccccaatcttgctataagattcccatttgcctgaaaagccggaaattttttcggaacatcgtataaatttgtaatcatacgccagtgggcaggagtccggacagataaataaatcgaagaatcaatggattcatttaagtgattgattagggtatgaacggaagtatcattcataaattcagacccatgcatttcaccccagtttccgataaagattccctgcatcagataaacagaatcagagtaccggtttacgatttcactgacttggtctatgtgggtaaggatggtagaaagtgagtctggttctgtcgcctttgcgataccatccaagtcatagagaaaacgaagaagaatctgagtgtcggtattggaccagtctttgaaaatctgttctaattgtgaaagggcatgttcactgatatcggtatttttataattttttaaattgatttctagaagaaccaaagaatcggaatacgtgtcagcgtgtgaggcaatcgcttcatctgtgtcatttaaagtatacccgatgatgtgataataaccttgataaggattttctaagacttcgttactttcagaaaatttttcagcggtaaaagtgacggattggcgcatacatcgaagaatcagaacaagaatcaaaagcccgaataagaaaatgagaaatctttggattaaattcattttttctatttcctccaattttttcgtgtttttgatattctatcaatttatgggaaaaacgtccagataaacttagaaaaaaatctttggatttttagcatactgatgtataataaatgaaaatacgaaagaaaaaatgaagaaaatggaagaaaaacttaagaaaatagtggaagaacaaaatttagaacaggaaaatccagaggaacttgccctgcttttatggcaggttttaaagcagtatgaacaggtagaatttcagacggtgaaaggacttgcgtttacttatgtaataaaaggcaacgaaatgtttattgacaggaaggaaaagtcgattacgaagtcttcggtcttacttgcgtttcaaaatttggttaagcaaggaggcatcatcagtggtccgaaaaagcttggaacatttggggcgagttatttatatccgatttttatggaattaggatggattgtggagtgacaggttttgtctatacagggagaaaaagaaaagattttattgaataatcgagaatagacgagaagaaaggttgcaaaattggaaacttatctgtataatgtggtattggctataaaaatgaaaacagaaaagtagaaaaagcacgaatacaataaagaaatagcaggagatttacaatgacaacattaaaaacaagcttattatcctacaagaaaacagaactggaatcttatgcaaagacattaggaattaaaagaatttcttctttaaaaaaagcagaaattgcagaaaaagtagcagacgaattattaaatccggaagtaatggcgaaacgtctggcaattcttgatgatgcgcagattgcattgtttgaaaaagcagcaaagggtgcttttatggcaacagaagcagagatggatacagcttatgaagcctgtgcactcgactacatgcaggtatctgaagagggaatgcttgaggttacagaagatgtagcggaagcttatgaaaaaatggaccaagagacatttgagaaaaagagaaaagaagtatcctggttagcgaaatgtctttctttttcagcagccatgtatggggtagcaccggttgatacggtccgcacagtctatgaaagccgtccacattatcatgcagataaagaaacgtttatggcattatttgatgaaatcccttatgagatcaatccatgtgttatttctgaagatgtcattatggacagaaaattaatcgcaggagatgcctatgaagcattattaaatgaacagcagggaaaaaaattctatgttccatcctggcagcaggtggaagaacttgctacaaagggatgtctgttagatgaagcttcttataagaaattgtttgcatttttccagaaagaattggagcttggatatgaggaggcagtagccgtaacagcagatatctggaatcatttgtcaacaggacatggtgatgtttacggaaaacttcaggaagtaattgaaaaatatcatttccagagtaaggaaggtgtaagaacattctctacactgcttcagggagtggtaaacagtaccagaatgattatttacagaggtcatactccaaatgaaatcacagtaaagagaccaaaaaataatttcccgaatttccacaccgcacagccaaagaaaaatcagaagatttatccgaatgatgtatgcccttgcggaagtggtaaaaaatacaaaaaatgctgtggtaaaaattaagaaataaatttaagaaacgaagcaacaaaaggaatgcccgattacaaagaaagagtgaggcaatatgaagaaaaaaggcttatttattttacttggattgatttgtatcgctgttgttggtggttcaggtgcattatttataacacgcgataagacaggtcctaaaattatagtttcagaggaccggaagatagcctacagtacagatagtgataaaacagtattgcttgacggtgtgacggcaatcgatgaaaaagatggagatgtttcggattcactgagagtcgagtctgtgcgaaacaatgaagatggttcattagaggtgacgtattcggcagtggatgattccaataatgtaacaaaacttacctgtaaggtggaaactctgaatcaggaaaattcagatgaagatgcgaaagaagaaaatacggaagcttctgaagagaatcaggaagaaaatcaagagaatacacagcaggatgaggaagataaagaggcacaaagtcaagaagaagcaaatcaggaagaagttgatgatagcgattctgatacagatgcagcaatcgcagcacttccggagggaagtccacagcttcgtctgtcgacacatcaggtagatttgcaggtgggtgcatcttttcaatatatggactacatagaaagtatttcagatgataaagatgaaacaaatgagttatatcgtaaaatttatctgactggtgaggtaaatacaagtcaggcagggaattatgagatttcttattatgttacagatagtgataagaatcagtctaatatagaaaaattaactgtaacggttcatgaataacgaaatggattctcgaagaattcactgtatttgcataatgagagttcgggaatgtctagaaagagcaggaggatgagaatgttatttgatatacattgtcatattttaccggcaattgacgatggctcaaaatcaatgaaagaaacagaaaaaatgtttcggatggccagaaaagaaagaataggaacgattcttgcaacgcctcattatagctgtgaaagagaacctgaattttataaaagatgtcagaatgtatacgaagaagtttgtcaaatgattcaagaaaagaatttgggaatacagctttatttgggaaatgagattttttacagttcaggagttttagaggcattgaaaagaggagaagcattaacattaaatcatacgaagtatgtactggttgaatttgcaccctatgtggaacttctgacgataaaaaaggcagtgcaggaacttcagatggcaggttattttccgatattggctcatattgagcgatatgagtgcctgaaaaaagaatcggaagtacaaaatcttgtagatatgggagcttatattcaggtaaatgcttcaagtctgacgggacgtctgggaatccgagtgcagtggtatctaaaaaaattaatgcggcatgacttggttcatgtcgtagcaacagatgcgcatggctcgaagaagagacgccctatgatacaggaagcagcaggatatatcaagaaaaaagccggagcagactactgtaagaaaataacagaagaaaatccggaaaaaataattagaggagagaggatttgtggataagttagaattaacagatgcaaaagaactgacaaatcaggaaaaagaagtgtatcgtacgttacggacaaatctggaatttacaggagtagaaaaccgtgtaattgcggttacgagctgtggaccggatgaaggaaaaagtacggtgtcttacaatcttggacgcactttggcttccgccggaaagacaacgttatatattgatgcggatatgagaaagtcaattttggcaaaccgacatcagattcaggggattgaaaaggggttaagccattatctttccggtcaggctgatatgacagaagttgtatactcaaccaataaaaagaatttctttatgcttccttgtggtctgtttccggttaatccaaccgaacttttaggaaatggaagactggacaaactattagaaggtttaaagaaaacatttgactatattattattgatactccgcctcttggaagtgttattgacgcagcagttgttgcaaaacgttgtgacggttctgtattggtgttagaagcagaccgcacaccaaaatcaatggcaaaaagtgtaaaagaacagcttcaggcggcaaatccgaatatcgtaggtgtggtattgaataaagtagatacccataaaggcagctattatggtaaaaaatatggaagctactatggaaaatattacaaataataaatacattgtgccagcacaatagaaacaggaaaagaggtacgaaatgaataaagaatacgatgacgaaatcgagattgatttaggtgcgttatttcaatgtcttctaaaaaaatggtggctgattgtaatctgtgcactgattggagccggacttgctcttggaagtaccattttactgattacaccaaagtatcagtccagtgccatgctttatattttgaataaaacaaccagtgtaacttctcttgccgatattcagattggtagtgcactgaccgcagactttgaagtgattgcaacaagtaagccggtaattgacggagcaattgaaacgttaaaaaaagaagaaggtaaaacatttacaagagagcagatttcaaaaatgctttctattaccaataaagaggatacccgtattctggtgattacagcaaccagtgaaaatcctcaggatgccagtattgtggcaaatgcggtagcaaaaaatacagcgactaaaatgggtgagattatgaaatctgatccgccgactactgtggaaaatgcagaaacaccgcaagattcaatcagtccaagcttgaaaaagaataccattttaggatttttggcaggagcagtattagtctgtgcaatccttgtcatccagttcttattaaacgataatattaagacagaggatgacattgaaaaatatcttggtctttctactttggtagcaattccaaaagaaaagggaaagagtagaaagaaacaggaagtcagacagttaaaagagggttctcatgaaacaaagaaataaatggttctgggtgttttttgtcatttttgtaattgcggttggagttggagcaggatattatttcgggcaaaaagaccgtgaacaggtttatgaagacctggctgagaaaaataaaaaaccgcaggaagaaacgaaacaggaagaacagacaacagatgaaccggcagaagaagaaaaaacagtagaaataccaatcgatttttcttctttaaaagagaaaaattcagaggtttatgcatggattcggataccggatacacaggtagattatccgattttacaaagagcatcggatgacttatattatctggatcataccattgatggtgccgagggacttccgggttctatctatacccagagtttaaattcacaggatttttcagataaaaatacggtgatttatggtcataatatgagagacgagaccatgtttggaggtctgaaatcttatatggatgaatcttatatgaaagctcattcgcagattcttatttatacaccggaacatattttgacctatcaggtatttgctgcggttacttatgataaccgtcatattttaaattcattcgattttgaatcagaggaaggatttcaggaatatctggattcattaaaagaagtgagaaatatgtcatcttatattgactctgatgttgaagtcacaacagaggataaaattattacattgtcaacctgtaatggaaacagtgatcagagatttctggtggaggcagtgcttgtaaatgaagaataagagtggaaaaatagtagcggtggcagtgcttgggattgccggaatcttatgcattgcactgctgacagcaggataccttaaaaaaacatcagaggcaaaaaaggtatcccaaaataagcagacatcgcaggcagaggtttcacaggcttcggataatacaattgaatataacggacataagtatgaatataatacggatttggaaaactatctgtttatcggtgtagataaacaggaagaagtaacccttcaagatacacctggaacagcaggtcaggcagactgtgttatgattctttcggcaaataaacaaacaaagaaagttaaagtgcttcaagtatccagagactctatgacagatgttgatatttacgatgcaaacggaaattattatacgtcagtgagagctcagattgcgacacagtatgcctatggagatggaaaacaaagcagttgtctcgcaatggaaaagacggtttcggagttgctatatgatttgccgattgcagggtatgtttcgcttgacattgcagggattcatgcaatcaatgatgcggttggcggagttacaattacggttcccgaagattatacttacattgactctgcgttccaaaagggggctgaaattacattgacaggggatttagcagaactttatgtaagatatcgtgatattaatcaagaaggaagcaataatgaacgtatgagacgtcagacccagtatattccggcattgatttctacgattcggaaaaatacaagtgggattgcaagttattataatctttataaagatgtacttgccccttatatggtaaccgatctgggagaaacccagattgatcggctctcttcttatgagttggaggaagagacagaatatgtcccaggtgaagtcgtgccaggggaaatcaatgaagaatttcatgtaaatgaagaacaattgcgtgatttgttgataaatatgttttacaaatcagttcaataatgctataatgagcgcaaagcacaaatagaaatttaggaggaaaatgattatgaaaaaatttatcgctcttgcatgtgcagcagtattaaccgtagcatcagcagtgacagcgtttgctcagccaagtgtaagtgtatctggtgtagtaacagctgtaacaactgctacagataaagatggaaaagctgtaaatgcaacatttggtgaagtaccggcagagtatgccagtgcagttgctgaagtaaaaacagaagcaaaattaaaagaactgcttggttctgactatacatctacaatgcaggttgttgatgtgaaaaatgtaacagttccggatggtacagtattccctgtaactatcacattcaaagtaacaggtgtaacagcttctacaaaagttgcagttcttcactacaacacaacaacaaaagcttgggaaaaagtagaaagcaaagccggtgatggtacagtcacagctacctttacttccctctcaccggtagcattcgtagttgacaaagcaacagctgcttctactacaactacaaacaaaggaacaacaactactacaaataagggaacaacttcttctactacagcatctgcatctacaacatcaccgaaaacaggtgaaacaaatgttatgatgtatgcaggaatcgtagctgtagcagcagtagcaggaatggctgttacaagaagaaaacgtgcttaattaactacatcatatagttatagcagctataattaagaaataaaaagtccgggtatggtgcttcccggacttttttaatttacgggaaattctgttctatgaggtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaaaacacttgcattttgtcgtacttcatagtataatcaaatacgttgtaaaaaaagagatggtcctctgttgttgattacattaagaacatccggaagaataaggagaaaaatcatgaacgaaattatcaaaaacattgaagatgctcagttaaaagcagaagtacctcagttcaacgtaggtgacacagtaagagtacacggaaaaatcaaagaaggaaaccgtgaaagaatccagatttttgaaggtgttgtattaaagaaacagggtggaagcaaccgtgctactttcacagtaagaaagaactccaacggaatcggtgttgaaaaaacatggccacttcactccccgaatgttgaaaaagtagaagtaatcagacgtggtaaagtaagacgtgcaaaactgaactacttaagagaccgcgtaggtaaagctgcaaaggtaaaagaattagtaaaataataaaagttagaggacagggacacatacttatgtatatgtcccttttcttccatcttgaggaaaaaaatatgagtaagaaaacaataagaaagccggcttttttgggaaaatataactggaaagcaatccttccatggatatttcagattgcagttgttttggcacttgcagcgatgatgtctattttcttttgtcagagtgtgattatgcaggagagcagtatggagccgagtatcgaaaccggacagcatctgctgatgaataaggtaacgtataagttaaaagaaccacagcgtggggatgtgattgcatttaaaaaagatggcaaagaacattccagtattcatgtaaagagaattattggactccccggagaaaaaattcagattaaagatggaaaagtctatatcaatgggaaactctataaagaaaaaaattttccaaatattataaatccggggcttgccgaacagcagattacacttggaaaaaatgaatattttgtacttggggataaccgaaataacagtgaggacagccgttttacagaagtacaaaatgtgaatgcaaaatatattgagggaaaaatctggcttcagatttctccgtcaaagaaaccggctttgattaaatagcgtaagcagcagaatcagcagaaagagaggcagatatgaattatcaatggtatcctggtcacatgacaaaggcaagacgtatgatgcaggaaaacattaaacttattgatttgattatagaagttgtcgatgcgagaattccgctttcaagcagaaatccggacattgatgagcttgggaaaaataaagcacgtatgattttgttaaataaatctgatttggcagatgaacgtgaaaatgaaaaatggcaggaatattttacccaaaaaggatttcatgtggttaaaatgaatgcaaaaagtggggcaggtgtgaaaaatgtactgccggttatcatggaagcctgcaaagaaaaaattgagcgtgataagcgaagaggcattaaaaatcgtccgattcgtgcaatggtagtgggaattccaaatgttggaaaatcgacatttatcaatgcatttgccggaaaagcctgtgcaaaaaccggaaataaaccaggtgtgacaaagggaaaacagtggattcgcattaacaaaaacgtggaattgttagatacacccggaattttatggccgaaatttgaagatcagagtgtaggtgcaaagctggcaatgattggttctatgaatgaccagattttaaatttggaagaactttcactggaattattaggctatcttcataaatgctacgagggaatcttggcacagcgttatgagttagaagaaagtgaagatcgtcttgctatgttaagtgcagttgctaaaaacagaaactgcttaaaaaagggaaatgaattagattatgcgaaggcttctaatattttactcgaagagtttagaaacggtaaaattggccggattacgctggaacaggcttaagggagaataaaaatggaaagcattcgcgagataaaagagaagcttcagtctgcatggacagaggaagaagcaagtaaagactggaaggaaagtatcaaaagtccactgaacgagtttctcacaagttattcagaggataccagaaaaggtgtggtttctctttgtgaaaaggcaaaaaaagagttcaaaaaactgcatgcagaacgagaacgaattgagtcattaaaggtctatgaacgggaatatgaacatttaggatatatctgcggaattgatgaagttggaagaggtccgcttgccggtccggtggtcgcaggagctgtaattctgccaaaggactgtaagttattgtatttaaatgattccaaacagctctcagagaaaaagagagaggaattgtacgataagattatggaagaggcagtcgcagttgcggtcggatatgcgagccctgcaaggattgatgaaatcaatattttacaggcaacttatgaggcaatgcgggaagcaatttcgaaacttgaggtgacacctcagattttattaaatgatgctgtcacaattccggatgttattattccacaagttccgattatcaaaggagatgcaaagagcatttcgattggagcagcgagtattatcgcaaaagtgacgagagaccgtttaatgaaagagtatgcaaaactgatgccggaatatgactttgcttctaataaaggatatggttcgtcggcacatatttcggcattaaagaaatacgggccttctccaattcaccgtgcaacgtttattaagaactttatataggatgaaattgtttgtagatgcagagagaagaaaaaaatacgcggagaatcggtgcttattatgaagaacaggcagcacagtatcttcaaagtaagggatatacgataatcaaacgaaattataagacaccttatggcgagattgatttaattgcaaaaaaaccggatttactggtgttttgtgaagtgaaatttcgaagcagtgaccgatatggaacgggacttgaagccgtaacggtaaaaaaacagcagagaattatcaaatctgcccgatatttttgtaattggtactgtggttcaaaagaatttgcttatcgctttgatgtgattgccattgaaccgcaagaaaagatttgtcatattgaaaatgcgttcgaattgtaaaataaagagttgattcatggggagtggagttatggataatggaatgatagagaaaagtaaaaaaatacgatggaaaacggatgaatacatgaaaacggtagaaaaaaacggtgtaacctatttaaaatatcggtcgtttgagccatttgagaaaaccatcattcatggattttccactcgtcttggtggtgtcagcaaggggatttatgaatccatgaacttaagttttacaagaggcgatgaggaagaagctgtttttgaaaattatagacgaatttcagaagcgattggatttttgccggaagatattgtgtgttcggaccagacccatacaacgaatgtacgaagagttggaagggcagacaggggaaagggaattgtaaaagcacgggattatacggacgtagatggtttaatcacgaacgccccgggaattgtgcttgcaactttttatgcagactgtgtgccattattttttgttgacccaaagaatcgggcgattgggctttctcattccggatggagaggaacagtcggaaaaatcggaaaagtaacggttgaagctatgaaaagagagtttggttctaatccggaagagatttatacagcggttgggccatctatctgtcaggactgttatgaagtgagtgaggatgtaattgttcagtttgaagaacagtttaaaaaagaaagccataaagatttattttacaaaaaagagaatggaaaatatcagctgaatttgtggaaggcaaatgaactggtcttcttagaagcaggaattaaaccggaacatattacaatgcctggaatttgtacctgctgtaatccgaattttttattctcacatcgtgcaagtcatggaaaacgtgggaatctggcggcgtttcttggattgcgcgaaaatcaataggctaaatgcataaaaattttgctgcttttttaagggatattacatagttgttacaaaatatgaaaaaaagactaggaatctgttaagaactgtgttataatcaagttcgtgatttgaaaaggagcttagattatgagaaataaaacatgtagaagtttatttttgtctttactgattgcaggacttaccgtaacaccttgttatgcagcaacgacacaaagtaaaatttctgatgcacagagtaagaaacagcagactcaggatgatttaaaagaagcgcagagcagaatttcttctctggaagcaaaaaaagatgatttacaagcttatttaacagaactggacagccagctctcagatttagccgataatctttcagatttgcaggaaaaatcagatgctaagcagagtgaattagaagaattaaaaaccgaattagaggcagcgaaagaccgtcagaatgaacagtatgaaagcatgaaattaagaattcagtatatgtacgaaaaatcaaatgattcttacatttctatgttgctggaatccaaaaatcttacagagtttttaagtacagcagagaatatcatgcagattaccaagtatgacagaggaatgttagcagcatataaagaaacacagcaggaaatcgaagaaaaagaagccagtgtggaaaaagagcagagtgcaatcgaagcacttcagcaggaaagtctggaaaagcagaatgaaatcgctgacttaatgaaaggaacaaacagtcagattgaagcttatacttctgagatttcaaatgaagaaaacagtgctcaggatttacttgcaaaagtaaatgcacaggaagcagaaattgataaattaattaaacagcagaaagatgaagaagcagcagccgagcttgcaaaacagaaagctgccgcacaggcaaaagcagctgaggaagcaaagaaacaggcagcagaagccgaaagagccgcacaggcaaaagcagctgaggcgcagcagagtgcaagtcagagcagtgcttcaagctccactcagcagactacagaatcttctgcttctacgaatacaaatacaaccgtaacagaaacaccaagtcaggaagaaaccgtagaggatacaagcagttctacaacagaagatacaaatgattcttcaagcagctccggcgattcttcttccagctctcagggaacttaccttggtaaatttaccattacaggttactgtaactgttctcagtgtggaggacagggtctgacagcaagtggaacagtaccgactgccggaagaacagtagcaatgaatggtattccatttggaacaaaattgttaatcaatggagtagtttataccgtagaagaccgtggtgttccttatggacacgtagatgtatattacgatacacatagtcaggcacttggaaacggaagatattacgcagacgtttaccagttaaactaagaatatagacagtaagaagaaatacataaaaaaacaaaagagaaatcgtagccaggaaaggttatgatttcttttttgttgaaagaaaaagcagacagagcattaaactctgtctgcctattaagtatgaattaagaataacgatgaagcaactggttaatcttttctgttgtagaacgaactttttctacagagaggtcatggtttaagatatccataatacttgccagatatttgctcatgtctgcctcaagataataaggacgggtgagaatgtccggatttttgtagtttaagtttgttgtgattactttatggatgtattctttttcgtaaaattcatcaaatttttcaagaccatcggtgaaaagaccaaaagtagtgcagacgataacacgttttgcttttctgtcttttaattgttttgcgacatcgagcatgctttcaccggaagaaatcatatcatcgattacgataacatcttttccttcaacagagtcacctaagaattcgtgagcgacaatcgggtttttaccatttacaacagtagaatagtcacgacgtttgtagaacatacccatatcaacaccaagaatattagagaagtataccgcacgctgcattgcaccctcgtccgggctgataatcattaagtgctcgttatcgattttaaaatcatctacagaagcacataatgtttttaaaaactgataggtcggcataaaattgtcaaatccggaaagcggaatggcattctgcatacgcgggtcatgagcatcgaatgtaatgatattagaaacacccatgtttaccagttcctgaagcgcaagtgcacagtcaagagattctcttttggttctcttatgctgacggctttcatagagaaatggcataatgacattgattcgatgtgcttttccggttgctgttgcaataattcgttttaagtcctgataatggtcatcaggagacatatgattgatatatccgttgactttataagtaagactatagttgcagacatctaccataacgaaaaggtcggtaccccgtacagattcattaatcacaccttttgcttctccggagccaaatctcgggcatttgctttcaattaaaaaagtatcttctgaataacctcgaaagcttaatccggatttattgtgggaatctaactcctgtctgaattgaacaagatgagaatccaccttctgtgccagttcatggcagctgtctaaggctgcaattttaatcggtgctactggaatggatttctccagcaaactgatattaaccataatgacctccaaattatattttttaaatttgattattaaaataccagaaattatttaaaacaaaaacatttctgatatcagttgtagataaaatagtgtttatcccaacttttcgacataattatacaattaagttataacatttatatatcatggcagtcaaggaaaaatattgctttttttcggtattgttggtattatagataataacggggtttaaaagcttcgtttggaaatgaggatagatatgaaacaaagcagacataaaatcaaagaaatacaagaaggaagcatcgcacaggaactggaattagaagctggagacgagctgatttcaattaatggacagccggttgaggatgtgtttgactatcactatctggtaaatgatgaatatatagaacttctggtaaaaaaacaaagcggagaagaatgggaacttgaagtcgaaaaagactatgatgaggaccttggaattgtgtttgaaaatagtttgatggatgaataccgttcttgtagaaataaatgcgtattttgttttattgaccagatgccgccgggaatgagagaaactttgtattttaaagacgatgattcccgactttcttttttacagggaaactatgttacacttaccaatatgagtgaccatgatattgaacggattattcattatcatcttgcaccgattaatatttcttttcagacaacgaacccacaactgcgttgcaaaatgctgcataatcgttttgcgggagacattttcccaaaagtgcagagattgtttgaagcaggaattgagatgaatggacagattgtactttgtaaagggttaaatgataaagaagaacttaaacgaagtattaaagatttatcaaaataccttccgcatttaagaagtgtttcggttgttccggtgggattaagtaaattccgggatggactatatccgcttgaaccgtttgaaaaacaagatgcggaggaagtcattgacttaattgaatcctggcagaaaaaactttatgaagcttatggactccattttattcatgcaagtgatgagtggtacctgttagcaggaagagaactgccggaggaggaaagatatgatggatatctccagctggaaaacggagtcggtatgctgaggcttttggaaacagaggtggaagaagccttagagcagagagagggagatgaacgaaaattagaactttcttttgcaactgggcggttggcatatggatttatcagaaaatatatggactggattcaggagaagtatccaaatgtcaaagttcacggttatcagattgtaaatgatttctttggtgaaaaaataacggtatccggtcttttgacaggacaggatgtaattgcacagttaaaaaataaagaactgggtgaatatctattattaccttgtaatctgcttcgaagtggagagaatgtatttcttgatgacaggacagtagaagaggtagaaaaagaattaaagattcctgtaaaaatcgtagaagaagacggcgcttcattagtttccgctgtcttagagaaagacgcaggaagagcacatagaaggagacagatgtatgagcaaaccgattgtagcgattgtagggagacctaatgtaggaaaatctacgttatttaatgcacttgccggtgagaaaatttcaattgtaaaagatacaccaggcgtaacaagagaccgcatttatgcagatgtaagctggctggataaaaactttacgttaattgataccggtggtattgaaccggacagcaaagatattattttgtcacagatgcgtgaacaggcacagattgccattgatactgccgatgttattatttttattaccgatgtacgccagggactggtggattccgatgcaaaggtagcagatatgctgcgccgcagtaataaaccggttgtactggttgtcaataaagtggacagttttgataaattcatgatggatacttatgaattttataatctgggaattggagaaccggtgccgatttctgcaagtggaaaacttggaattggtgacatgttagagaaagtagtcagtcactttgaagagggtgcaggtcaggcagaagaagaggaaattccgaagattgcggttgtaggaaagccaaatgtgggaaaatcttctctgattaataaagtccttggagaatcccgtgttattgtttcggatattgccggaactacaagagatgccattgatacaaaagtagaatggaatggaaatgaatatgttttcattgatacggcaggtcttagaagaaaaaataaaattaaagaagaactcgaacgatacagtattattcgtaccgtaaccgcagtggagcgtgcggatgtcgtcgttatgatgattgatgcaacggaaggggtaaccgagcaggatgcaaagattgccggaatcgcacatgaaagaggaaaaggtgtcattattgcagtcaataaatgggatgcaattgagaaaaatgataagactatttataagtttactaataaagtgcgtgaaatcctttcttatatgccttatgcagaaattttatttatttctgcaaaaaccggacagagagttccgaaattatttgaaaccattgatatggtgcttgaaaatcagacccttcgtattcagaccggtgtactcaatgagattatgacagaagccgtggcaatgcagcagccaccttcggataaaggaaaacgtctgaaattattctacatgacacaggtttctgtaaaaccgccaacatttgttatttttgtaaatgataaagagttaatgcatttttcttacacaagatatctggaaaataaaatcagagaggcctttggatttaaaggaacttctttaaaattcctgattcgtgagagaaaggacaaggagtaacaaaaatatgtgggcgaaaatcgtatgtcttgtaatcggatatggattcggattgtttcagaccggttatttttatggaaagagaaatggaattgacatccgtaaatatggaagtggaaatgcaggaacaacaaatgcactgcgtacgcttggaaagaaagcaggagcaattactcttgcaggagactgtttaaaagcgatcttggctattttactggtcagtctgatttttggaagagcatttccggaacagattatgcttttaaaattgtatgccggagcgggttgtgtattgggacataatttcccgttttatatgaattttaagggtggaaaaggaatagcagcttctgtaggaatgttaattgcatttgactggcggttatttttcttatgcgcggttgtattttttaccgtatttttcttaagtcattttgtttctctggcatctttgctggcgtatttcttttttgtcgttggagtgattgcttctggacagatggggcgttatgatgtacctgcatcggtgcttcatgaaatgtatattgttgcatttcttttgatgcttctggcattttggagacatcgtgcaaatatcaaacgactggcaaccggaaccgaaaacaagattgaatttggtaaaaaataggaggtatttgggtatggcaaaagtgagtgtagttggggcgggaagctggggaaccgcgcttgcaatgttattatgtaataatggacatgatacaatgctttggtcacacagagaagaacaggcagaggaattaagaacagcaagagaaaataaagcaaaactgccaggggttaaaattccggaagaaatccatgtaacttctgatttatcggaagctttgattgataaagatgtgattgtaatggctgtgccgtctgtggcagttcggacgacagctaagaaaatgtcttcccatatccggtatgggcaggtcattgtcaatgtggcaaaaggaattgaagagggcagtctgatgacactgaccgatatgatagaagaagaaattccaaattgtcaggcatgtgtgctttcaggaccaagccatgcagaagaggtaagccgtggtcttccgacaacctgtgtagtcggggcaaagacaagagcacttgcggaatatctgcagaatatttttatgagttccgtatttcgggtttatatcagcccggatattttaggaattgaactcggagcggcattaaaaaatgtgattgcgctggcagcagggactgcggatggattaggatatggagacaatacaaaggcagctctgattacccgtggaattaccgagatggaacgtcttggtgtggcaatgggcgcaaaggcggaaaccttttatggtttatcgggtattggagatttgattgttacttgtgcaagtgttcacagccgtaatcgaaaagccggtttcttaatgggacaggggagaaccatggaagaagccatgaaagaagtaaatatggttgtagaaggtgtttattcagcaaaagcagggatggagcttgcaaagaaatatcacgtggaaatgccgattattgaacaggtcaatgaagtactgtttgaagggaaaacaccggcggatgcagtaaaagagctgatggttcgtgataagaaaatagaaaactgggattttgaatggtaatttacaaaggagtgtactttaaagggaagtgcactcctttttcttaagaaacattaaggggcttttagaaaaattttcgatttgtgcaaataaattgtaaaaaagaattggtatgataaaagagtaagaaaattgagagctgttctcaaagtctttatacatatatttatgaaacaggaaaggaagtctagatggaaaagacgctgatacagttaaaggatatttgtaaagtttataatcctggagaaaatgaagtgcgagcattagaccatatcaaccttgagatcatggagggcgaactggtagcaattattgggcagtccggttcaggcaaatctacgctgatgaatatgctggggtgtctggatgtgccgacaagtggttcttattatcttcatgggcaggatgtttcacatttaaaagataatgaactttctgcaatccgcaataaagaaattggttttatttttcagggatttaatttgattgcaaatttaaatgcagttgaaaatgtggaacttccattaatttatcgtggaattggaaaacaggagagaagaaaactggcaaaggaagcactcgaaatggtaggtcttgggcacagaatggaccataaaccatcggagatgtccggaggacaacagcagagagttgcaattgcaagagcaatcgcagcaaaaccgccggtgattttggcggatgagccgacaggaaatctggattctgcttcaagtaaagaaattcttcagattttaaaagaccttcacagcggaggacgaaccgtgattctaattacacacgatgacaaaattgcggaacaggcatacaggattatccgtattttggatggaaaaatagaatctgaccggaagaatgataaaatattggaaagcagagaggaaataaaatgaaaaaaagaaacgtaaaacaactggcgggaatgtcctcaaaaaagaaaaagtggattattgttggagcaatagtagtagtcatagcagtcggtgcagtaagtgtgtctggaagaaggcaaaaagattcattgccacaggttacggtagaacaggcgaaaaaacaggatgtcacttcaagggtggagacaagtggaacggtagaaagcctgaaagtgaagacttatttttcaccggtcaatgcgacaatttccagtcttggttatcaaaccggtgatttggtaaaaaaaggagatacactggttgcgtttgaaaccgattctttagaacaggataatgaaaaaagccagttaaataaaacagcaacggtaagtggttcaaaagatacagcacagaaagcggtagagagtgcacaaaaagtaaaagatgcacaggcagaacttcccacattggagcagaatgttaaaaattatcaagagtatgtggcgtctttaaaaacagccattgcggaccgtacccgcacacttgcggaagattcttcaaaggcttcttctgatattagtatggcattgacaaaagcacaggcagaactggcaaaaatgcaggagaatatgtcgagccttactgcattgcagcaggagcaggaggcaaaaattacagagtttacggcggaaatctcagagactaaaaaagaaggtggagatacttcggaggcggagcatcaattaaataatttcaatgatgccttaaagcagacaaaaaatcagataaaagaacagcagaattatattgatgaacaaaatgatgtgattacacagttaaatgtacagcagattgaagcacagagtaatgtaaaagatgcagattcagatgaacagattgttgcatggcagaatgaattagaagatgcgacaacaaaactttcagaattacagtctgaactttccgaaaagaaaacggtagcagaaggttcttctgatgctgaactgactcaggcagcaaagaaccagttggaggcaacggacaatctcgcagaattagaggcagcaagtacacaggagttattagaaaaaggccgtcagggaattaaagcagattttgcaggaattatttcaaaagaagaaatttcagaaggaacaacagcgacgcagggaatggaactggtaacggtttcaagtaatgaagaagttgcagtaaacgtcagtgtatcaaagtacgattatgataaattaaaggaaggtcagaaagcttctatcagtattgcaagtcatacttatgcgggaaccgtttcatctatcagcaaggttgcccagacaaatgaaaaaggtgcacctgtgatttcggcaaaagtaaaaattgacaatccggacgaaagtattttccttggggtagaagcaaaagtttcgattgagacggatactgcaaaagatgtggtatgtgttccagcctctgctgtgaatacagcgactgacagcacgttttgttatgtgttaaaagatggagtgattacgaaacagaatattacaacaggtgttacagcgagtgattacatagaagtagaaaagggattaaaggcaggagatgaagtgatttcagagcttccagaaggcgtagaagcaggaatgaaagcagaggcggtaagtgggagtacagaggaatagcgatgggacagacatttgagtatctaaaaatggctctgcaaaatatcagggcaaataagggacgttccctgctcaccatgcttggcatcattattggaatttcttcggttattacaattatgtcggttggagcgggctttaaaaatgaaatgaataaacagctggactccattgcaggaggacagatttatctttatttaagcgatgaggggcaaaaaagagaagagtatatgacagaagatgattttgctcagattgaatcaaagatagatggggtgacagggacttctccggtctttggcgcagcaggttcaactaagacattaaaaggggaatttacggtcaatcttaccggaggaggaacggcacagcaggaaatctcaaaatggaaagtggtaagaggacggtattttaatcaaagtgatattgatacggcaaaccgtgtctgcgtagtcagcaaaaaagatgcgatttccatgtttggaacagacgacgtagttggaatgaatatcgaaattgcatcggataacagtaccggtgattttcaaattatcggaattgtagaacaggaaaatttaggaaacatggtcacgatggaatatggagatgaacagagtgtgtctatggatgttccgtatacggcaatggatgtatttggatatgatacttcttcatttgcatatctttatattacaacggacaaaagtgcggacactggaaaggttgcaaatgcggcaattgcacttttaaatcaattgcattacagttcgggagaaagctattatgatatggaaaattttacggaccagatgtcatctatcaatgatatgctgaatatgattaccggatttatttcgctggttgccggaatttctcttttggttggtggaattggtgtcatgaatattatgttagtatctgtgacagaacgtacgagggagattggtatccgaaaatcattaggagcaaaaacttcttcgattatgatgcagtttttggcagagtcggcaatcattgcctgcattgggggcttaattggaattacaattggtgtggcacttgcttatgcggtgtgttcgattccaacacttggttttacgccgggaattaaattatctaccattcttttggcaacggtattttcttccggaattggaattgtgtttggagtttatccggcaagaaaagcagcaaaattaagtccgatagaagcgcttagaagaaactaaatattgagaaaaaagaaattagaaaaatataagagcggagaaaagaaaaatgacaggaatcatataaaaaaattcctgtcatttttttagtcctgataataaggaagcatgtcttccggaatgccggcagttctttgtttgatgtccattgcattaatcgcattcatttcttcttcggttaaagaaaaatcaaagatatctgcattttctaaaatgcggtctttatgagtggattttggaattgcagatactccctgctgtaccagccagcgaagtccaatctgagcggttgttttctgatatctgctgccgatttctaagagaagctggctatgcagataagcacctctggcaagcggagcataagcctggacggcaattccctctgatttgcaataagaaagcagttctttttgattgaacagaggatgaaactccacctgattgacagcaggtttgatatcggaaaccgattttagtaattctaattcatggatacggaagttagaaacaccgatggatttgatttttccagcagattgcaatttttccagcgttttccatgtgtttgtgaaacatccgggaaccggccagtgaattaaatacaaatcaacataatcaagtccaagtctttccagacttctgttaaaactatcttctacgtcaccaagacgctgtgcattattccatatctttgttgtgataaataattcttcccgtggtacatcaagtgcttttaaacctcgtccgactccgtcttcatttttataaacagaagcggtatcaatcagacgataaccagagcagacggcgtcttgaatggcttgttccacttctgttccggcatctgctttgtatactccaagtccgagaagcggcattttatgaccatcatttagtaaaatggtattttcaccaagtgacatgaaacagccctcctttactcttaaatctacacttcgagtctttctatgtttattgaaaagtgtcgagcatagatttcttttcctactttaaactacgccttatcttatcataaagatatgaagtaattactccaaatttattaattttttaataaattcatgttattattaaaaaaaggagttttaaaattatgaaattttttcatttggcagatttgcatttaggaagaaaattattaggggaatctttgatagaagaacagagttatatattagaagaaattatgaaaaatgtccgtgtggaaaagccagacggaatctttatctgtggagatatttatgataaatatattccgtcctcggaggcagtggcattgtttgattcttttttagaggctcttgtaaaagaaaattgtgaagtatttattatcagtggaaatcatgacggagcaagtcggctcgaatttgcaagtggattattaaaaaagcagaaagtccatatctgtgggacttataagggaaagatagagagtgtggaacaaaaagatgagtatggaaagctgacggtgtatctgcttccgtttttgcgtccggatatgttgagagcttatgaaaagaactgtccccaaacttatcatgaagcagtaaagcaagtgctgaaagatctgtcttataataagaaagaacgcaatcttttactgactcatcagtttgttgtggacggacaaatgtttcccgaaacttcagaatcagaaataaaattaataggagggatagaagcagtagatgtatcctgttttgaaagatttgactatactgcccttggtcacattcatcgggcacagaaaataaaaacggaatggatacgatatgcgggttctccacttgcgtattccttttcggaagtaaatgataaaaaaggaattacagtagtggaattaaaagaaaaaggaaattgttctgtgcgaaagattttgctgcatccaaaaacgaaactggcagttttaaaagataagctggaaaatttactttctgaagcctatcaggaattccggacaggctattatttatcaattcgagtgacagacgaagaaatactggagtatccggtgcagagattacagcaggtcttttcgggaatgttggaatgtcggattgaaaaccgtagaacgttggctcagggaattatggaaacggcggatttgtctgctataaaaaaaacaccggagtctctctttgctgaattttatgaaaagcaaaatgggatacctatgaatgaaatcgaaaagcagatactaagaacggtacttggtgaaatggaggagatgaaaggtgagaccaattgagttggaattagaagcgtttggaccttatgcagaacgcacacagatttcatttgaacaatttcaggaaaatggattgtttttaatttgtggagataccggttctgggaaaactacgatttttgatgcaattgcatttgccctttatgatacggcaagtggagagacgagaaagatggaaacccttcacagtgattatgtagaagcaaaaaagtgcagtgaagtaagactattattttcgcataaaggaaagcgttatcaggtaatccgcagttttaatggaaaacgaaaaaatgaagcggtattagaagaggagaaaaaagaaggattaaccggacgaaaagcggtaaacgagagaataagagaaatacttggacttgactatcagcaatttaaacagatttcaatgattgcgcaaggagagtttttgagtttactgcttgcaaaaagtgaagtgcgcagtgagattttcagaagagtatttgataccgaactttataaaaggctggcagaagtattaaaaagtaaagcggttcatttaagagaagaggagaagctgcgaaaagaaagagaacatcagctgatgtcaggtctggaagaagaattagaaaaagaattcaaaaaagaagatgagagctggcagatcccagaagaaattgaaaagattttagaaaaaaagatagaagagttaaaagaagaagagaagaggcagaaaggggtagagaaagaagaggagactgataaagcggaaattttaaaagccctggagcagataaaaacgataaatcgggattttcaacagctggaaaatttgcaggaaattttgaaacaagaaaaggaaagaaaaagagagtttgctcagaaagaaaaagaactggataagataaagaggggggcgctttatatcaaaccggttttggagcgatatgaggaaaagaaaacagcacttgagacagaagaaatcaggtatcgggaaatttgcggaaggcagaaagcacaaaaacagaatacaggaaaattaagacaagaacaaaaagaggcggaacaaaataaaagaaaatacgaaaaaatacagtgcctgaaagcggaatgtctggaaatagagacagaatataaaaagctgaatatactttgtgctctccaaacggaaaaagaaaaattacaggaacagttaaagacagaaatcagagaagcaaaacaggcagtggttgaatatgaaacagaaaaagaaaaatttttctgtgcgcaggcaggaattctggctaaagctttaaaagagggagcgccgtgtccggtctgtggttctgttttacatccgcgtccggccgttgttttaggagaagtacttacccaggaagaactaaaagaaaaagaacgtaagaagaaacagttagaagagaaaagacagcgaaccatgcagacatttttacagctggagaaagaagtagaaaaaagtacaaaagagatatcggtaaacccggattttttctggaaagaagttcatgcaaaactagaacagacaggacaaaaaagaaaccagaaagaaataaaaatcagagaacttgaacaagatgtaaaaaaggaagtgagagacagtgagacaatccaaaaagagtggattgaaaatctggaaaaagaagcgggaatcttaaaagaaaaagaaatatgcaaagagcagatagaagcgttaaaagcagagaaaaaagcatgtcagatgaaattaagaactgcggtaaaagaacaaaagtttaaaagtgaaaaagaagccagattattttgtgaaaaacaggaaaaacttttgaaattagagcaggaaattgcagattacaaaaaaaggcttcacaagtttttagggcagataaaaattttggaaaaaacgcttttggggcaaaaaaaacagtcggaagaagaaaaacagaaaaagcttgaacagacagaacaaaatctggaaaaaatcaggatggaattaagagaaatttataaacgtatcagtttttatgaaaagaccttagaacagctgaaaaaactgtgggaagaaagcgaaaaaaccagaaaggaaagactggcacttttgtcactttcggatacggcatccggaacacttgcaggaaaaccgaaagtatcctttgaacgctatgttcagtctgcatatttcaaacaaattgttgtggaagcaaaccagagactggaacagatgacagatggcagatatgagttgttggtagaggagacgggaacaaacaaaaaaagccagagtggtctggatttgcaggtatacgactatcataccggaaaggtaagaagtgtccgttctctttcaggtggagagagttttcaggcagctctttctctggcacttggagtgtcgggagtcataagtcagtttgcggggggaatttgcatagaaaccttgttcattgacgagggatttgggagccttgatgagcagtctttagaacttgctgttgatactttgcgtcagctttcgggtcagggatgtatgattggaattatttcgcatgtaaaagaattaaaagagcagatttttcatcggattgagataaaaaaaggacagaaaggaagtcagattttaacagtggtctgaacctttaaaaaaacataagaattgcttgataaaacggcaaaaaacatgtataataatggtattgataaattattgtcatttactgcgcccaattaaaattaagctgcagagaaaggagaaaaaatgcatttaattaatgatgaaaacggcaatgtcgttcctcatgggcatgagcataatcacagccacgaacatacgcatggacatgcgcatgaacatggatgcagcaattgtggtgataacgagtgtcagggaagctgtacagaagaagtggtagcacttttaaattatatgctttcccacaatgaacaccatgcagaagaacttgaccagatggcagaaaatcttgcaaaactgggaatggaagatgcggcaaaaacgattaaagaaggtgttgcggatttccagaaaggaaacatgcggttaggtcttgcactgacacttgtgaaagaacatttgaaggactgaaattaaggaggcgtaactatgtgtcttgcaaccgttcaaaaaagtgatgatactgtagtatgcagaaatgtcagcagaattgatgtggatggagaaaaggtaatcattcgagatattatgggtgatgagcgcgtaatagaaggaaaaattcttatggttgatttagcaaacagccttgtaaaactggattgtcagtaaaaacagatctttgagactgctacgcacagtcttgaatagataaattataatgtggaggtaagtaaacgataaagttatcagaagtgatgaaagagaaaatgcttttatccttcgaactgtttccaccaaaaacagacaaaggtatggaaaatcttccgggcacaattgaacatttgtgcgaatacaaaccggaatatacttcctgtacttatggagctggtggaacaaatgttggtaagaacatggatgtgtgcaagatgattcaggctgccggaaccataccggtaacacattttacctgtatcggaaacacagcagacaattcttaaccaggctgctacaattaacatggcactttcacgtaatggctgtgtaatgcctcgtgaactttgcaaaattatttctaagaattggattttcccaaatctattcgacaaagaaccattcgatattgatgtagaaggcaagaaagctcgcttcaaagaagctggtatcgaatacacaatgaaacagattgatgaatatcgtgcacttggtgtaaatggcatccatctgtatgcactgaataagtggaaagacgtttctgagattattgacagatccggtcttcgcacattagtgcaagaaacaatattaaagaaatataggaggtgccctgtaaatggcacatgtaattgcgattgccggtaaaggcggtgttggtaaaacaacacttaccggattgattattcagtatctgggcaagaaaggcaaaggtccgattcttgcggtagatgcagatgcaaattcaaatttaaacgaggtccttggagtggaagtggaagaaacgcttggtgatatccgtgaggaagtggccagagcggaaatgtcaaaggataatccgattccaccaggagtgtcgaaagcagattatatggaatttaaatttgacgatgcattaattgaagatgatgattatgacttgctggtgatgggacgtacgcagggaaaaggatgttactgttttgttaacggacttctgcaggcgcagcttcagaggctggaaaaaaactatccttatatcatcgtggataatgaagccggcatggagcatatcagcagaggagttcttccgaatatggaggttgccattcttgtcagtgactgttcaagaagaggcgtacaggcagttggaagaattgcacagctgattaaagagtgtgacatgcacccgaagaaagttggtttaattatcaaccgagctccgaacggggtactgaatgaaggaacaaaagctgagattgaaaaacagggattaaccctgcttggcgttgttccgcaagacgaaacggtatatgaatttgattgtgacggaaccccgattgtagatttgccggaagactctccggtaagaaaagcaattgttgaaattattgacaatctggggctctaaaaaaactgggcctgccggaaaggggaggccctaagaaaaaaaagaggcgaaattcaaggaggatattcatgagtgaattcaaattaaccacagtagaagaattcgaagctgctactgagagactcctggagacaggggcaaaagttggcgcggatgcttggcagttccgtgtaaaaaatcagactccgcactgtaagtttggtgaagaaggtgtctgctgtcgtatctgttctatgggaccatgtcgtattacaaaaaaagcaccgagaggaatttgtggatgtgacgtacacggtatcgttggacgtaactatctgaaatttacagcaggtggttctgcaacacattccgaccatggtcgtgaaatctgtcataccttatatgaatcatcagctgatggatgttatcaggtaaaagatccggaaaaactgattcgcattgcaaaagaatggggtgtagagacagaaggaaaagatatctacgacttagcacatgaagttgcagaaatgggtctgtgggaatatggtaaaccgtttggaacacagagattcttaaagagagctccgcagtcacagcaggaattatgggaaaagaacgaacttgcaccaagagcaatcgaccgtgaagtttcatgttctttacatatggctcacatgggatgttcctctcttccggaggcattaatcaaacagtctatccgtgcaggtttatctgatggatggggcggttccatgatgggaacagaattctctgacgtactgtttggaactccaaagccaatcgatacagaagcaaaccttggtgttatggtagaagaaaacgtaaacatcgtagttcatggacatgacccgagtctttctgaaatggtttgtgaatatgcagactctccggaaatgattgcttatgcaaaagaaatgggagcaaagggaatcacagtatccggtgtatgttgtacatcaaatgaagtagctatgcgtcgtggtattccgatggcaggtaacttcttacagcaggaaaacgttgtacttacaggcgcttgtgaagcaatcgtagtagacgtacagtgtatcttcccggcactcggacctttaagtaaatgcttccacacaaaattcatcacaacatctccgattgcacagatgccggattctgaatttatccgctttgatgcaaaaacagctgatgaaaaagcaaaattaatcgttaaaacagcaattgaaaacttcaaaaacagaaaaccggaactggtacatattccacagttaaaacagaaagcaactgtaggatattctgtagaagcaatcatcaaatgcttagacggtgttgcaaacagtcaggttgatgaaatgggaacagtaaaacctctgttacagtgtgtaacatcaggtgttcttcgtggagcagttgcaatggttggatgtaataacccgagaatccgtcctgaccttgcacatatcgaattgatgaaaaaattaatcgcaaatgatatcgtaattattgcatccggatgttctgcacaggcagctgcaaaagccggtcttatggataaacgtgcaaaagatatctgtggtgatggattaaaacgtgtttgtgaactggcagatatccctccagtccttcacatgggttcctgtgtagatatcagccgtatgatgattcttgcttctgaactggctaaatgtgccggtacacatgtttcacagcttccagttgttggatgtgctccggaatggatgtctgaaaaagcagtttccatcggtaactatgtaattggtacaggtatcgatactttccttggtgttgacccttatgtttccggttccagcgaaattgctgaaatcttaacaaatggtacaagagagtgggtagaagcagcatttactgtggaaaaagatattgataaacttggagacgccatgatcgcacgtatcgaagaaaaacgtgcagcgctcggaatttaagagcagaaaaaacggctgtctgatttagaactggattagacagccggtataagaaaggtgaatgaaatgaaaatagcagtgacaggaaaaggcggtgtgggtaaaaccacatttgcagcgactttagcccggctgtacgcagacgaagggcgaaaagtccttgcagcagatgtggatccggacgcaaaccttggactggctttaggattcgacgaggaaactttagattcaattgttcccattacaaaaatgagaaagctggtagaagagagaaccggtgcaaatgaagtgaataagttttttaaaatcaatccgaaagtggacgatattccggatacttattcaaaagaggtaaatggagtaaaactgctggtactggggactgtggaaaccggcggtggcggatgtgtctgcccggagcatgtaatgcttcgcagaatcattaacaatttggtcattcatcgagatgatgtcgtaattatggatatggaagccggtctggaacacttaggccgtggaaccacccagtcaatggaccagtttattgttgtgattgaaccgggagccagaagtgtacagacttataagaatgtaaaacgtctggcagatgacctcggagtgaaacaggttcgtgttgttgcaaacaaagtaagaaatgtcgaagatgaagagtttgtaaaagctcatatcccggcagaggatctgttaggcttcattcactataacacagaagtgatagatgcggatcgccaggggaaatctccttacgatttcagcaatactgtaaaagaagagatcacaaaaattaaaaacataatcgacaaaggattatgagaaatcaggaggaagaaacattgacattatttgaaaccgtatttagcggaaatgatgctgtttatggattaaccgaaaatgcaattaatgcagcaattgagcagcatggtgcagacaaagcaatcagctttccagatactgcttacagcttaccttgctactatgcagtaacaggtgttaaagttgctactttaggagaattaaaagaagcgttaggtgtagtaaaaactcttatgacaagagaaatgaaaacacatgatgtatttatgtcaggtgttgctactgcattatgtgcagaatttattgaagtgttaaaatacatcgacggtgcaactccttatgaagcaccatgtgcaggacatgttccggatgcaatcatccgtgaacttggtgtaccgcttgtaacaggcgatatcccaggtgttgcagttatccttggttctgctcctacaacagaagaaggtgttgctttagtaaaaagctatcaggcacagggtatcttagttaccttagttggcggaatcattgaccaggttgaagaagctggaatgaaaacaggtgcaaacgtacgtgttatcccgcttggaaaagatgttacagcagttatccatgttgtatctatcgcattaagagcagctcttatctttggtaatgtgaaaccaggtgatgccgcttctctgatgacttatacaaaagaccgtgtaccggcatttgttaatgcatttgctcctctcgatgatgttatcgttgcatgtggtgcaggcgcaatcgctcttggattcccggttatcacaaatcaggaaggcgtttctgaagtaccgaagagcttaatctgccagccagatgttgaaaaattcaatgcaacatctttagaggcacgtgatattaaaattaaaattacaaacattgatattccggttgcttatgcatctgctttcgaaggtgaaattatccgtcgtggcgatatgcaggtagaatttgatggttcccgtgtagactgtgctgagttagtacatactgtagaagcttctgaaattgaagaccataagattacagttgtaggaccggaagttgacgaaatggaactgggaagcaaaaacagcattgcttatgtcgttaaagttgctggtagaagcatgcagccagattttgagccggttatcgaacgtaaattccataactatatcaactgtatcgaaggtgtatatcatacaggacagcgtgatatgcagcgtatccgtatcagcaaagatgcatttgcagctggattccgtatcaaacacatcggtgaagttttatacgcatccgttaaaaatgagtttgatgcagttgttgataaatgtgaagttgttatttacacagacccggctgaatgtacaagaattcgtcatgaagtggctattcctacattcaacaaacgtgatgaccgtctgaaaaacctgacggatgaatctgtagacgtatactacagctgtattctgtgtcaggcattctctccatctcacgtatgtgttgttactccggaacgtcttggtctgtgtggtgcggtttcatggctggatgcaaaagcaacaaatgaacttgatccgaacggaccttgtcaggtaatcacaaaagaaagatgtatcgatgagagaatcggtgaatacgaagatgttaatgaagcagttcgtaaactgtctcagggtgctcttgaagatgtatctctgtactctatcatggaaaaaccgatgacatcttgtggatgtttcgaatgtatctgtggtatcgagccattctcaaacggtgttgtaattgccaaccgtgaatatgcaggtatgactcctcttggtatgacattcccagagatggcttccatgacaggtggtggtgttcagacaccaggtttcatgggacatggtaaacactttatcggttccaagaagttcatgaaagcagaaggcggtatcgaaagaatcgtatggatgccaaaagaactgaaagaatttgttgcagacagactgaatgaaactgcaaaagaattatacggaattgaaaactttacagatatgattggtgatgaaacaatcgcaacagacccagaagaactggtaggattcttaacagaaaaaggacatccagctctttctatggagccaatgatgtaattagaggttcattccttagacgataatcataataagcggtgggggaagctgtggcctaacccgccgtttataaaaaatatacaaggaggctaataagaaatgccgtttaatcagaaaccacagaaattcaatgcaaatattaacacagttgaaatcggctgcggggacaaagcaatcaaattaggaggagaatgtacatatcctttctatacatttgatgcgccaatggaaaacgcaccaaaaattggtgtggaaatttccgaccttggacttgcagacgtacctggaatccaggaatattatgccggtgcaacaacaatcggtgaaatcgctaaaaaggcagaagcaatggaaggtgcggactttgtttgcttacgtcttgaaggtggagacccgaatggtgaaaacaaatccatcgaagaactgattgctgttgtaaaagaagttggcgaagcagttacctgtcctttagttgttgaaggatgtaaaaatgtcgaaaaagattctgaattactcccgaaagtagcagaagctcttcagggtaaaaatgttttaatcctttctgcaagagaagaaaactataaagctgtcggagcagcagcaggacttgcttataaccagaaagttggagcagaatccgctgtagatatcaaccttgcaaaacagttaaacgtagtattaacacagttaggtgtacaggcagaaaacgtagttatgaacgtaggttctgcagcagttggttatggtttcgaatatgtagtatctactatggaccgtatcaaaggtgcagctctttctcaggatgacaaacagttacagatgccaatcatcactcctgtagctgacgaggcttggaacgtaaaagaagcaatggcttcagaagcagatatgccggaatggggaccagcagaagacagaggaattagtatggaagtacagacagcagcagcagttctggcttctggttcagatgctatcatcctgaaacatcctaagtctgttgcaactatttccaaaatgattaaagaattaatgtaatcgtaagaaacaggaggataaaaaacaaatgggattatcaggtattcaaatctttaaaatgacaccaaaaaagaactgtaaggagtgcggatgccctacttgtatggctttctcaatgaaagttgctcagggtgctatggatatttcacagtgtccacacatgtccgaagatgctctggctcagttatcagaggctactgcaccgccaatgaaaacagttaaaatcggtgccggtgaaaatgaattctctttaggtggagaaactgttctgttcagacatgaaaaaacttatgtaagcaaaacaagatatgcagtatctttatgctcatgtatggacgacgccgcaatcgatgcaaagctggcagaaattccgaaagtggattatgaacgtatcggtgaaagaatgtttgctgaattagtatatgtaaactatgcagcagatacagacaaagacagatatgttgaaatcgtaaagaaagcagcagctttaaacagaacactgattctgggatgtaaagatgtagagcttgcaaaagcagctcttgaagtttgtaaagaagcaaaaccagtattaaacggtgctgatgcatcaaactatgctgagatgagcgcagttgctacagaagcaggtgttgtacttggcgtaactggaaaagacttaaatgaattatatgatactgttgcagctctggaaaaagcaggaaacaaaaacctgattctggatgttggaactgcttctatcaaagaagcttacggcaatgctgtacagattcgtcgtgcagcagtaaaagatcaggatagaacattcggatatccgactctggttaatgttgcagcacttgcacatggtgacagagtaatgcagcaggcactgttatctatgttcacaatgaaatacggttctatcgtagtagtagaaactctggattatgcagaggctcttccattatttggattaagacagaacgtatttacagacccacagaaaccaatgaaagtagaaccaggtatctacgcactcaacggagcagacgaaaactccttatgtcttacaactgtagacttcgctcttacatacttcgttgtttccggtgagttagagcgttctggtgtaccttgcaacctgattatcagtgatgcaggtggactttccgttctgacagcatgggcagcaggaaaactttcttctacatctgtagcaaaatacattcaggaaaatgtagaagataaagtaaaatgcagaaaactggttattccgggtaaagttgctgtattaaagggtgaccttgaagcaaaattaccaggatgggaaattattgttgcacctcttgaggctgtacagttagttaaattcttaaaagacctgactgcataatgattttttagaatcacctttccggggagatctgttctccctggaattgtaagaataacatgaaaaaaaggagaacaaagttatggcaaaatttgttacaatcggtgaaagactttccaccacagctccagcagtaaacaaagcatttttagaaagagatgcagaaccaatcttaaaaagagcaaaacagcagcttgatgcaggtgctgtataccttgatgttaacatcggacctgcagaaggatatggtccggaactgatgaaatgggctgttcagctccttcaggaaaactttgacaacgttccgcttgctctggatacttctaacaaagaagcaatcgaagcaggtatctctgtatacaaccgtgcaaaaggaaaaccaatcgtaaactccgctgatgcagcaggaagaatcgaatacgttgaccttgcagcagcaaacgatgcaatcgttatcgcactttgcaacggtgaaggaatcgcaagagacaatgacgaacgtatgggatatttacagacactgctcgaaagaggtttagagcatggaatggaagaaacagatctgtggtttgacccgctgttcctggttgtaaaaggtatgcaggacaaacagatggaagttcttgaattcatcaaaatgatttctgacatgggactgaattctacaggtggtctgtccaataactcaaacggtatgccaaaacacattcgtccaatcatggattctgctttagtagctatgtgtatgatgaacggtctgacatccgcaattgttaacccgaatgaccttcgtctgatggaaacaatcaaatcttgtgatgtatttaaaaacaacacattatatgcagattcttatctggaactgtaatctacagaagttaaaataggtaagaaaatctgggcagtaattaacgagagaagcagatgttatgtctgcttctctccgattaaaaagaatcagaaaggcgaattcctatgtttaaagtgacttttaagtttgaaggggcggaagatgttatcacttatgcccaggaaggagaaaaccttctcgaaatcgcaagaaagagcaatgtagcaattgatgcaccttgttctggaaatgcatcctgtggaaaatgtcgagtaaaattaatcggaggagagattgagtctccgaaaacccgtcatatcacagatgaagaatatgcagaaggctggagactggcctgcgtaagcaaagtaaccggagatgtagaagtacaggtaccggatattgcatctgcctacagaagccgtatgaaagttgctgatttaagctctaaagaagaagttgcaatttttgaaaaagcaaaatcggatgtagaatcagcaggaatttctttgacaaacagcctggatgttattaatgttaaaatgaatgtgccgactctggatgacacgatgccggataatgaacgtctggttcgtgcaatcaaaaaacagacaggaattaaaaaagtacggatgccatattcagtactgcgtaaaatttcttatgttttcagagaaagcaattttgaagtacagtgtgtcattagaagcacagaaaatgatatttttatttatgatgtctataaaaaagatgaaaaagtggtaatcggaggattggcaattgatatcggaacaacaaccgtttctgctttattaattgatatgaagtctggagaaattcttggaaaggcttcttccggaaatggacagattcgatatggagcagatgttatcaatcgtattattgaatctatgaaaccaggtggaagtgagaaacttcaaaaagcggtaattcaggagacaatcaatccaatgattcagcagatgtgccgtgcaagtggatttaaaccggaacatatctatcgtttaagcattgcttctaatacaacaatgaatcatctgcttacaggaatgaacggagatccgattcgtatggaaccgtatattcctactttttataaaacaaattctttatttgcctcagatattggaattcaggtaaatccagatgcccatattattatggctccgaatatcggaagctatgtaggtggagatattacagcaggtactttagtcagtatgctgtggaatcgtccggaattttcattatttattgacttaggtacaaatggagaattggtatttggtaattctgattttatgatgagctgtgcatgttccgcaggtcctgcctttgagggtggagatatcagctgtggtatgcgtgcaaccgatggtgcaattgaagcatgtacaatcgacaaagaaaccatggagcctacttatagtattattggagaagaagggcagaagccggttggtctttgtggctcgggtattattgatgtaatcagcgaattattccgtacaggtattattaatccgaaaggaaaatttgtgcgggagggaaaacgtgtccgtcatgaccattttggcatgggaagttatgtgctggcttttgaagaagaagctggttcagtaaaagacgtggaaattaacgaagtagatattgataattttattcgtgcgaaaggtgcgattttctcggctgttcgtacgatgttggcatctttggatttcgatgtttccatgattgatgatgtatatgtagccggtggaatcggtagtggtatcaatatgaaaaatgcggtgcatattggtatgttccctgatatccctctggaaaaattccattatattggaaactcttctttatccggggcatatacgatgttgttatcaagagacgcagagcgaaaatgttatgagttagcgtccaatatgacctatctcgaattatcgactgtgccaagctacatggatgaatttgtagcatgttgtttcattccgcatacggatagaactctgtttccatcggtgacagaagcttaggaggaaaaaatggactttgattatgcaaaagacagcaaggaacagcgtccttatgaatattatctgaaaacctatcaggaaatagacccaaaagaaatcagtgaaagaactggatttttctatgacgaagagaaaaaagtgtttactgtagtgtttatgggtagcacttatgaaatttcgtttccggattataagatttctcataaagaagatgaaaaaggggtatatccgttagaagaggcgatgaatgccaagatttttatggttcgttatctgtctgaaaaagcaaaagctccttcttccggaaagtttttaacttatcgggaggtaccgtggggagaagtttattttagacaatttcagggacgatgcctgatgcgtctggcatttagctatggaaataaacttgaggcatttaaaaaggtaatgactgcaatgggagcaaaaccgttagagcagggagactgtgcctttgagcttgagtttatggaaggattcttcattcgactgattctgtgggaaggggacgatgaatttccaccatcttcacagattttattctcagataattttgcagtaacctttgccgcagaagatttagcggtggcaggagatatctgcattaacatgatgaaagcagtcgaaagaaaactgtcttaatattgaaaataatctctcgaatgttaaatttgggaatcataaataaattgaacataaaaataagcactttgtgcttaaatataaagaaaagagaggaataacattatgggattttcaaccgtaccatgtaatgaatttgtggaagtactggcatcaaaagcacctgtacctggcggtggcggagcatctgcattggttggtgctgttggtactgcacttggaaatatggtaggaagccttaccgttggcaagaaaaaatatgcagaagtagaagatgaaatgtgggaattaaagaaaaaatgtgatgaacttcagaaagatttcctgcgtttaatcgaaagagatgcagaagtgtttgagccgctttccaaagcttatggtatgcctagagagacagaggaagaaaaagcagaaaaagcaagagtaatggaaatcgtattaaaggatgcctgctctgtaccgatggaaattatggaaaaatgctgtgaagcaatcgaagtgattgttgaatttgcagcaaaaggttctactctggcaatcagtgatgcaggtgtaggagctgcattctgtaaagccgcgttaaaaggtgcaagtttaaacgtctatatcaatactaagtccatgaaagacagagagtatgcggaagaactgaacaaaaaagcggatgcaatgctggaaaaatatacaaaaattgcagatgaaacatttgacagtgtactttccagactgaaataagagaaaaacaattgcggaggtttaagaaatggcaaagagattactgggtaaagaagtaacagcagcattaaacgaaagaattaaagcagatgcggaagcactgaaagcaaaaggagtaaatccaactctgtgtattattcgtgtcggtgaaaatgaaagtgatatttcttacgaaagaggagcaacaaaacgttgtgaaacattaggagtagcatgtgaaaaaatccttcttccggaagatgtaagtcaggaagaactgcttgcaacaatcgataaagtaaataaaaatgaccagattcacggagttttattattccgtccgcttccaaaacatctggatcagtctgtaattgagaatgcacttgaccctgcaaaagacgtggactgtatgacagatggttctatgtctggcgtattcacaggcaaaaacgttggtttccctccatgtacaccacaggcatgtatggaaatcttagatcattatggaattgactgtacaggtaaaaaggcagttgttgttggaagaagtcttgttgttggtaaaccggcagcaatgatgctgattaagaaaaatgcaactgttacagtgtgtcacacaagaacagtagatatgccatctgtagtaagagaagcagacatcgtaatcgtagcagcaggacgtgcgggtgttgtagatgacacttatttaagagcaggtcaggttgtaatcgatgtaggaatcaatgtaaatgcagaaggaaagctttgtggagacgttgattttgaaaaagcagaaccaatcgtagaagcaattactccggtaccaggcggtgttggaagtgtaacaacatctgttttagttggacatgttgtagaagctgcaaaacgtaaatttgcttaaattacatagttgttattcttaggaatagacaggctggaattcaattgcaagttccagtctgttttttgttctaataatgaaaaaacgggcatatactttagcagtataataagggggaatctatatggatacctataatatctataaagatatacaagcccgcacaaggggagaaatttatattggtgtggtaggaccggtacggacaggaaaatctacctttgtaagaagatttatggaattggcagcgcttcccaatatggaggaaaaccagcaaaaagaggtaagagaccagcttccgcttagcggttctggaaagttaattacaaccgtagaacccaaatttatcccaaaagaagctgcaaagatacaaatagcagagggattggaagcaaagattcgtttaattgattgtgttggatatatggtgcctgaggcggcaggaaatatagaagaaggcaaagaacgaatggtaaaaactccctggtatgcacaggaaattccatttcatcaggcagcagagactggaaccaaaaaagtcatagaagaacattccaatattggtctggtggtgacttgtgacggctcatttggggaaattccaagaaaaaattacatagaaagtgaagaaaaaacggtggctcagttaaaaagagctggaaagccatttttgattcttttaaactctcagaagccatacaaagaagaaacactggaattagcggaagaattaaaaaagaaatatcaggctggtgtgattagtgtaaactgtgagcagttgagaaatgatgatgtgacgagaatccttgagaaagtgttgtatgaatttccgattgttcagatggaattttatattcccaaatgggtagaaatgttatcttcggagcattatttaaaagaagaactgatttcgtgtgtacagcagatgatgcaaacgatgcattacataaaagatgtgacaaaagaccggctggagtttgaaagccagtatgtaaaaggattattcttagaaacattagatttatcaagtggaaaaataaaaatccgtattgatatggatgacagctggtattatgctattttgagtgaaatgacaggggttgatatttcagatgaatatgaactgattcatatgatgcaggaactttctaagatgagaggggaatacttaaaagtaaaagatgcaatagagtccgttcaggcgaaaggatatggtgtggtaactccggataagacagaaattcgtttggaagaaccaattatcataaaacaaggaaataaatatggagtaaagattaaatctatcagtccttccattcatttgattcgtgccaatatagaaacagagattgcgccgattgtaggaagtgaagaacaggcaaaagatttgattgcctatattaaatccaacaattccggagaagagagtatctggcagaccaatatttttggcaagtcaattggacaattggtagaagatggaattcatcggaaattaatacagattagtgatgaaagtcaggtgaagttacaggataccatgcagaaaattgtaaatgacagcaagggcggtctggtctgcattattatctaaggagtctgtattattgattgacttttgagccatgaaattatataattacagggagaaagaaagtagaaaaagcagagtcggtgcagatgtggaaacaggtgaaatccctgtgcaagtccgttactgtacagccagatacacatgtgccggagaaaaagaatatctgcggcaaccggatgttttgaaagaataaaatgtgccgttgtcaggaaatctgacagcggttttttgattcttatgaaacttcattttaaccaaatcaaggaagtcccctgcttcaattgcaaaaagcaataaacaggggtggggacttgcttgtatcaggagggggcaagccccttctgataagctgcgtagcagctatttggttatgagcaagtagcgaaagcggattgcgaatatccgcttgactaatcaaaaactgccctgctttcagaaactttagagaagagaaaaatacagcgagagaaaaggacagagatggcacataaaacaggtctggaagaatattacattattaaaaataataaaaaaatgcgttatggttatacgactggttccagtgcaacggcagcagcaaaagcggcagttaaaatgctgttgtcaaaagaagtagtgaacacggtatcgcttatgacgccaaaagggattttattaaacctggagattcttcatatcaacatcgaagaaaaccaggtttcttgtgctgtaaaaaaagatggtggggatgaccctgatatgacaaatggtctggaaatctttgcattagtcaaaaaaacgaagcaggcgggagtctttattgacggtggagaaggagttggtcgaattactaagaacggactggaacagccgataggaaatgcggcaatcaaccaggttccaagacgcatgattacaaaagaggtggaagagatctgttctcagtatgaatatgaaggcgggatttctgtcttgatttttgtaccgaaaggagaagagattgcaaagaaaacctttaatccaaaacttggaattgtaggtggaatttcaatcttagggacttctggaattgtagagccgatgagtgaggctgccttgattagaagtattggagtcgagatgcgtcagagaattgcaaatggttctgagtatctgttagttacaccgggaaattatggaagttcgtatctaaaagaggaactgaaattaccgcttgcggaatctttaaaatgcagtaattatgttggcgaaaccgtagatatggcagtcgatatgggagcaaaaggaattttgtttgtggcacatcttggaaagtttgtaaaggttgcaggagggattatgaatacccattcccgttcggcaaatgcaagggcagaactgatggcagcaaacgcaattcgtgcaggtgcttcattagagactgcaaagcagattcttgatactgtcacgacagatgaggccgtgcagattgcgaaagaagccggaattttaaaggggttgatgcaggaaattaccggtcggattgaagaaagtctcaaccatcgttcttatggaagactggtttgtggagctgtaatcttttccaatgagcatggctatcttggacagacagagcatgcagatatgttgatgagagaaattagaaaaaagacacagaaagaggagaaaaaatgacaggaaaattatatggacttggagttggaccgggagaccctgaactgttgacagtaaaagcacttcgattggtaaaagaaagtgatgtagtagcggttccgggagcagttgcagaggaaagtgttgcctataaaattgtaaaaggggtatatcaggaattagatgagaaaaatctcattccaatcccaatgccaatgacaaaagacccggctgtattagaagaaaatcaccaaaaagcagcagataccatagaagaacttttaaagcagggaaaacaggttgcatttttaactttgggagacccgactgtgtattctacttatttgtatgtacataaacgaattttagagcgtggttatgaagtagaaattgtaagtggaattccgtctttttgtgcggtagcagcaactttaaatatgggactggtagaaatggcagaaccgcttcatgtgattcctgcaacgtacaatgcggataccatggatgaggtattaaaacttccggggacaaaagttttgatgaaaaccggaaggaaaatgaaagcagtcagagagagtattttaagaagtggtcaggatgcagttatgattgaggattgtggcatgccgagtgaaaagatttataaaagtgccgaagaaataccggaacagtccggatattattcattaattattgtgaaggagaaaaaataagatgatacattttgtaggagcaggtagtggagcaccggatttaattacaatccgaggaaagaagtttttagaggaagcggatgtgattatctatgcaggttcattggttaatccacagcttttagactatgcaaaagaaggttgtcagatttataacagtgccaagatgaccttagaagaagtactcgatgtgatgagagaggcagaaaaagcagaaaaaatgacggtacgtctgcatacaggagacccatgtctgtatggagcaattcgtgagcagatggatgtacttgatgaagaaggggtttcttatgattattgtccaggtgtcagctctttttgtggggcagcatcagcacttaatttagagtatacacttcctgaagtatcccagagtgtgattattacaaggatggcaggtagaactccggtaccggaaaaagaaagtattgagtcatttgcggcacatcaggctacaatggttgtattcttaagtacgggtctgttagaggaactttccaaacgtttaatcgagggtggatattccaaggatacaccggcagcaattgtatataaagcgacctgggaagatgagaaatcttttgtctgtacggttggtacattggcacagactgcaaaagaaaatcagattaccaaaacggctctgatgattatcggagaggcagttgcacattcaaattatgaacggtcaaaattatatgacccgggatttacaacagagttcaggaaaggaacggatgcagaatgaagatatcaattataagtttcagcagaagcggatatcgcattggagaaatgctcagttggtttttaggcgaaggcgggcatgaagtagaggcatttacaaagagtaaatacacaaaaaagatattggatgagtcacaggtagaggcagatgacaaagcatttcgtaatgtaaaagaatttgcaaaaccgattgattcttctcttcgagactggacaggacgccgctttgcacaaagcgatgcgattatctttatcggagcttgtgggattgcggtacgaagcattgctccatttgtgagcagtaaaaagacagaccctgcagtagtggttattgatgagcagggaaaatttgcaatttctttgttatccggtcatattggtggggcaaatgaactgacagaggaaatcagcaatcttctgcatgcaacaccggttattacaactgcaacagatattaacaataaatttgcagtggatgtatttgcaaagacaaacggatgctatatttctgatatgacaatggcaaaagaaatttcagcagcacttgtaaatggaaatagtgtaggatttgccagtgattttccatgggttggagagattccgaaagagttacagctgttggatgaagaggacgagacaaaagaaaaaccggagatgggaatttatgtgacaaatagttatctgaaacatccatttgtacataccctttatttggttccgaagattattactcttggagtaggctgtaaaaaagatacaccggcagacactgtggaaaaagtagttagaaaagcgtgcgatgaactcttaattccatctgtttcgatggagctggtagccagtattgatttaaagaaagaagaacagggaatcttagaatactgtaaagagagaaatcttccgtttgaaacttacagtgcagaacagttaaaagaagtagaaggaagttttgcagaatcgaaattcgtagaggagacaacgggtgtagacaatgtctgcgagcgaagtgcaattcttggaagtagtaaacatggagaaaaaagtaatctgattcttagaaaatatgcagaggatggcgtgacagcagcacttgccagacggaaatggagcgtacagttttgaaaaaattatatgtagttggcatcggacctggtgcttatgagaaaatgacaattgaggcagcagaggctttaaaaaacagtgatgtaattatcggatataccgtatatgtagacctggtaaaagaacattttgccggaaaagaatttttgacaacaccgatgaaaaaagaggtggagcgctgtaagatggcatttgaagaagccatgaaaggaaagacggtatccatgatttgcagcggggatgccggtgtttatggaatggcaggcttaatgtatgaagtaggaatgaattatccggaagtggaactttctgttattgcaggtgtaaccgcagcaacaggcggagcagcggtattaggagctccactgattcatgacttctgcctgattagtttaagtgacctgctgaccccatgggagaaaatcgagaccagacttttagatgcagcgcacggagattttgtgatttgtctgtataatccgtccagtaagaaacgccatgattatctgcagaaagcctgtgatttaatgttaaaatataaaagtgaagaaacagtctgcggaattgttggaaacattggaagagatggagaaagtgagaaggttatgacgttaaaagaactgcgtgatacacaggtcgatatgtttacaacggtatttattggaaattctcagacaaagaatatcaatggaaaaatggtgacaccaaggggctataaaaatgtgtaaggtgcttgtatttgcagggacaacagaaggcagaaaaatttcagaatttttagaaaaacaaaaaatccagacacatgtctgtgtagcaaccgagtatggagagacacttctgccaaagagcagttatctaagcgtctctcatgagaggttggatgaaactgcaatgaaagaggcgatgcaaaatatgcatccgtctcttgtcatcgattcaacccatccttatgctgcggaagtaacaaaaaacattcgcaaggcatgtgaggagacaaaaacggaatatgtacgtcttttacgtgccggaagtacagaggatacaaagaatgattccagtgtatatgtagattccgtggatgaggctgtagaatatttaggtacaacaacaggaaatgttttagttaccacgggaagcaaggaaattcataagtatacaaagattgaaaattataaagaacgaatttttgcgcgtgtactttctctttctaatgttgccgaacactgtaaaagtcttggatttgagggacgaaatctgatttgcatgcagggaccgttttctatggaattaaatgaggcaatgcttcgacagtttgattgtcgttatctggtaacgaaaatgtccggagtgacaggcgggtatgaggagaagctggaagcggcaaagcgggcaggctgtatctgtgtgattgtaggtcgaccattaaaagaagagggacttggattaatcgaatgtaaagcattattatgccagcgttttggattaaaacaaaaccagaaagtctctttggttggaatcggaatgggaaatccggatacctgtacaatagaagcaatcaaagcaatcaaagaggcagaacttttaattggagcaaaacggatggtcgaatctgtgttgcactcggaacaggatgtgttgattgaatataacagtgaaaaaataaaagtatatctggataagcatccggaatacgaaaaaatcgcggtattgctttctggagatgtcggattttacagtggtgcaaagaaactgcaggaaacattaaaagagcgcgaggtaaggcagataagcggactttcgtcaccgatttattttatggcgaaaatcggacgctcctgggatgatgcggttatcaccagtgcacatgggaaagaagaaaatctggtggaactgataaaaacacatcagaaagtggtttcgattttaggaacaaaagatgcggtggcaaatcttgcaaagacgttgacaaattatggaatgggaaaggtgattttttttgtaggagaacgtctttcttatccagacgaagcaattgtgcagggaagtgcagattccttctgtgattatgagggcgatgccttaagtgtgatttatatagaaaataaagaggcggaaggcttaccatccacacatggcgtaaaagatagtgcgtttttaagagataaagtgccaatgaccaaagaagaagtgcgctgtgtttctttggcgaaacttggcttaagggaagattctgtctgttatgatgtgggagcgggtacaggttctgtgtctgtcgaaatggcacttcgcacgccaaaaggcagggtttatgcaattgaaaagaaagaaacggcagtggagctgttaaaaaagaacaaacaaaaatttatgacggataatctctctgtaatagaaggagtggcaccggaagcattagaagcacttgaagtaccaacacatgcttttatcggaggctcttctggaaatatggaatctattttaagattactgcttgaaaaaaatccgaagattcgagttgtaattaactgtattgcacttgaaagtgtagcagaagccaatcgttgcatgaaagtactgccatttgaagacgtagaaattatacagttaagtgtaagccgtgcaaaaaaaatcggaagctatcagatgatgatgggagaaaatccgattacgattttttctgcaacaggaaagaaagaagaaaaagaggaggaatagccgttatgaagatacctcgttttttgatttgtgcaggggcaagtggaagtggcaaaaccttgattacctgtggactgcttcaggcacttataaatagagataagaaagtagcttcttttaagtgtggaccggattatattgacccgatgtttcataccaaggtaatcggaactcattcgagaaatctggattctttttttgtgaatgagcctgttttaaactatctgctttccaaaaactgcaaaggtatggacattgcagtgatggaaggtgtgatgggctattatgacggtgcaggagggattacttccaaagccagtgcttatgaagtggcctctatgacaaagacaccggctgttttgattgtaaactgtaagggaatgagtgtttctattgtgccttatattaagggatttttggaatataaagaaaacagtcagataaaaggcgtaatattaaatcagatgcctgcaatgctctatccgagagtaaagcagttaattgaatcagagttagaaattcaggtacttggatatgtgccgaaagtagaggattgtgtgattgaaagcaggcacttaggactaattttaccaaatgagattgcagattttaaggaacggcttgcaaagcttgctaaggtgttagaagaaaccattgacatggaaaaactgcttttgcttgcagagaatgcaccggatttagaagaagaaattccatgggacaaagacagcgagtatgcgtttcaattagaacagccggttcggattggcattgcaagagatgaggcgttttgttttatttatgaggataatctgcagttattacgaaatatgggtgcagagctggtagagttttcaccgcttcatgatgaaaaacttccaaaaaacctgtatggattgattttttatggaggttatccggaactctttgcaaagcagttagaagaaaatcattcgatgcgggaagcgattaaaaaggcttatgaaaatggaatgcctgtgattgcagaatgtggcggttttatgtatctgcatgagacgatggaagatatggaggcaaaaccgcataaaggagtcggcattataaaaggagaatcctatcggacttcaaagcttggtagatttggctatatttcgcttaaatcaaagacaaatcgagtgttggaagaaaattgtgatgagattccagcacatgaatttcactattttgattccacttcgtgcggaagtgattttgtggcgaagaaaccatttagcagcagaagctgggagtgtattcatttagaaaaccatcttctggcaggatttcctcatttttattattacggaaatcctgctgtggcaaagggaattttaaagagttgtcagatgtataaagataagacgatatgaaaggattctgagactacataagaaaaggagtatgaaaatgaaactggaagaagcgctgaaaaaaatagaaccattagatgaaacagcgatggatgtatgcaagaaaagatgggatgcgattgcacatccactgcacagtcttggaaaattagaagatatgctggtacagatttcagggattaccggcagtgcggatattgatgtaagaaaaaaggcactcgttccgatgtgtgcagataatggtgtggtagaagaaggtgtcacacagaccggacaggagataacggcgcttgtctgtgaaaattttcttcagacgaaagcagtatcaagtattatgtgtaagagtgtaggtgcggaaatttttccagttgatgtgggagtggcaagtaacgtcagtattttgaaccgtaaaattgcttatggaacaaaaaatatggtaaaagaacctgctatgacaaaagaacaggcagttcaggcaatcgaaaccggaattgaaatggtggaaacgttaaaagcaaaaggctatggaattattgcaactggagagatgggaattggaaatacaacgacgagcagcgcagttgcttcggttattttaaaacgtccggtagaagaaatgacgggaagaggagcagggctttcttctgagggattgaatcgtaaaattacggcaatcaaaaaagcggttgcccttcataagccagatccagaagatggaattgatgtggtttccaaagtaggtggttttgatattgcaggaattgcaggtctttttattggcggtgcagtatataaagttccgattgtaattgatggagtaatttccgcagtaggagctttggttgctgtcaccatctgtccgcagtgtaaagattatatgctggcaagtcatgtgtcaaaagaaccggcaggacagttattactggaaagtcttggaaaagaagcgccgcttcactgtgatatgtgtctgggagaaggaacgggagcacttaacttatatccattattagatacagcggtagcggtttattatggaatgagtgattttagtggaattggcatggaagcttatgttccgcttcagtaataaaagagataataagagagatatgaataataggtgagaaattagccattgagagatggaatgaaaagaggataaaaagatgattacacttgtaaccggaggcagtggaagtggaaaatctgcttatgcggaagaggtattgactggttttggagactttccacgaatttatattgccacaatgtatccctttgatgaagagagtaaaaagagaattgagcgtcaccgaaagatgcgggcagagaaaaattttaatacaatagaatgttacaccggtcttcggaacttagaacttcccgaaggctgctgtgtgcttcttgagtgcatgtctaatctggtagcgaatgaaatgtttcaggaagatggggcaaaggatgacacagtgccagagattttagaaggaatttcagaaatcgaaaaacaggcaaaagaactggtcattgtaacaaatgagattttttcagatggaattgactatgatgaagaaacaaaacgatatcagagttatcttggaaaaatcaatcaggagctggcaaagcgtgcaaaagcggtggcagaagtggtttatggaataccagttgagagaaagaatcaaaaaggagttatccgggagaagaaaaatggcacagaaaaatgaaaagaaaacaacaacggcaggtcagcttgcaaacagttttaaaattgcattttctatgtattctaaaattccaatgccgcaaagtgagtggagtaaagaaaatatgcgttatgtgatgtgttttcttccgttaatcggagcggtcattggatttttaagctggatttggggaacatatgcaggactgtttgtacacagccataatttttatacagtcatccttgttttgattccggtgttggtaagtggagggattcatttagatggactgcttgatacatcagatgcattaaattcttatcagccaagagaaaaaaaattagagattttaaaagattccaatgcaggagcatttgcaattattgtgggaatctgctatttccttttatattttggtgtttacagtgaaatgacagtaagaagccttccggttatctgcattggctttgtcttatcaagagcgctgggagcattgtctattgcaacatttccaatggcgaagaatacgggacttgcagcaacattttctgacggagcacagaaaaatacagtcaaagtggtttctgttatcgtggcagtactttcaatccttttcatgattgcagtcagaccgttgattgggctttgtgtattggttggggcaggctgtgagtatctttattattataaaatgtccatgaaacaatttggtggaattaccggagacctggcagggtttcatatacagatatgtgagctggtgattgccttatccgcagtaattggacaaatcataggaggatgagagatgagactggtaataggcggagcttttcagggaaagaaagcttatgtggcagaaaaatatcagcttccaaatgaaaaaatgacagacggaagtgcagcgtcttacgaagaaatttttgacactccgtgcctgtatcattttcatgaatgggtaaaagaaaggttaaaagaagggaaaaagttagagagtctggaagaagagctgatagataaaaatccagatattattctgatttccaacgaactgggatatggagttgttccgattgacaaatttgacagagaatatcgggaaacaaccggaagagtctgtaccagactggcaaagaagagtaaaagtgtagtgcggattatctgtggaatggagtgtgtattaaaagatgagtaaattttatctgattcgccattccattacaaagggaaatctggaaaaacgctatattggagcaaaaacagatgaaccactttgtaaggcaggatatgaactgctcaaagaaaagcattatccgaaggtagaaaaagtcattgcaagcccgatgaagcgctgcatcgaaacggcacaattattgtttccggatacacaaatacagatagaggaaagtttaagagaatgtgactttggtgagtttgagaacaaaaattatcaggaattaagtcagagtaaagcgtatcaggcatggattgacagcaatggaacacttccatttccgaatggagagagtcaggaaagttttagaaaacgaagcacaaccggctttaagcgttgtattgagcaatgtttaaaagaagaaataaacgaagcagcatttgttgtgcatggaggcacaattatgagtgttttaagttcccttgcgacaaaagaaaaagattatttttgctggcaagtcaaaaatgcagagggatttttagttgaagttaccaaagaagaatgggaaaatacccgtaaagtaaccgtaatcaaagaaataaacgggaaggaataagaaaatgataaagtggacagcggtaatgcttgtgattggatttttactggatttattgattggagacccgagatggctgtatcacccggtaagaatcattggaaacagtatcactttttttgaaaagtggctgcgtaagtgttttccaaaaaccccgtcaggagaaaaaatggcgggatgtgttttagtgattctgatttgtctggaaagcagtctggctccatttgttttgttatttcttgcatttaaaattcataccgcagtcggtatagtgcttggttcttttttttgttatcagatgcttgcgacaaagtctttaaaggatgagagcatgcgtgtctatgagaaactagaacatggaacaatcgaagaagcaagagtggcagtttcaatgattgttggacgtgatacacagaatctgaacaaagagggagtcacaaaggcaaccgtagaaactgttgcggaaaatacttctgatggaattattgcaccgattttttatatggcagttggtggtccggttttgatgtatttatataagggaatcaacacgatggattccatggttgcctataaaaatgacaagtatctgcattttggctggtgtgcggcaaaattagatgatatcgcaaattttattccggcaagaatttctgcttttttgatgatcttagcagcttttgtatgcagattagactggaaaaatgcatggcgtatttttaaaagagaccggtataatcatgccagtccaaattctgcacagactgaggcagtaatggcaggggcattagatgtggcacttgcgggaaatgcttattattttggaaaattatatgaaaagaaaacgattggagatgcgattcgcaaaattaagccggatgatattatacttgcaaaccgcatgctttatgtggcagcaacaatcagtgtgattttatttgctgtcattcggattcttttacagctgatatagaaaatgtatgccggaatttcaggaatgtttgattgaaagcgatctataaaaaaggctttgagcgtatatatattgtagtagaatggagaaaagaaaatgagttatcatacacatggaggagatgtctatcgaaataaaaatgtgattgacttttctgcgaactgtaatccatttggaactccaaagtccgtaaaagaagcagccgtacaggcaatggaagaagtctttcattatccggatacggattgtcaggaattaagagaagcaattggagtttatgaagaggttcgaccggagtggattatctgtggaaatggagcagcggatttaatttatcgtctggtgttgggtacaaaaccaaaacaggcagtgctgtttgcaccgacttttgcagaatacgaacaggcattagaaatcgtgaattgcgaagtgaaacattatgaattaaaagaagaaaacggtttttgcgtggaagaaacccttttggactggattacagaaaagacagatatcgtatttttgtgtaatccgaataatccaaccggagtactcttagaaagaaaatttatcttagaggttttaaaacgctgtaaagaaaaaaatagtctgtttgttttagatgagtgttttgttgattttgtggaagaacctgaaaatcatacaataaaagatatgctgaaagaatatccgaatctgtttcttttaaaagcctttacaaagcgttatgcaatggcaggagtcagactgggatatggtttgagcagtaatcaaaggttgttggaaaaaatacagcattgtgggcagccgtgggcagtttctaccgtggcacaaaaagcagggattgcagcattaaaagaagaagagtatgtaaagagaagtatggcttatgtgcatgcacagagaaagaaactgataaaaaatttaacgcttcttggttataaaacctttgattcaaaggcaaattatattttctttcaaggggaagaaggcttgtatgaaaaatgtctggaaaaaggaattttaatccgggactgcagtaactattatggattaaaaaaaggatattatcgtgtggcggtaaagcttcaagaagaaaatgaaaaactgttggaagttttaaaagcatgcagaaaggatggagaaaagtggcaaaagcgattatgatacaggggacaatgtcaaatgcaggaaaaagccttttgacagcggggttatgccgtatttttaaacaggatggatataaagttgctccatttaagtctcaaaatatggcattgaattcttttattacagaagagggtctcgaaatgggacgtgcccaggtcatacaggcagaagcggcaggaatcaaaccgtctgcgctgatgaatccgattttattaaaaccaaccaataacatgggaagtcaggtcattgtaaacggagaagtgcttggaaatatgagtgcgaaagattattatgcatttaagaaaaatcttcgtccgaaaattttagaggcctatgaaaaactggcatccgaatatgatatcattgtgattgaaggagcaggaagtccggcagaaatcaatttaaaacaggaagattttgtcaatatgggaatggcaaagatggcaaaagcaccggtgctcttagttggagatattgacaggggcggagtatttgcacagcttgtcggaacagtgatgctgcttgatgaagatgagcaggatatggtaaaaggtctgattatcaataaattcagaggggataaaagtattttggaccctggagtggaaatgttagaagaacggactaaaattccggtggtcggagttgcaccgtatttaaatgtagatattgaggatgaggatagtctggcagaacgcgtaaaaggaaatcgagaagtggatttaattgatattgcagttatccgccttccgaggatttcaaactttacggattttaatgcacttgaagtgattcccggagtttcagtacgttatgtcagaacggtaaaagaactcaaaaatccagatatgattattcttccgggttctaaaaatacaatggaagaccttttatggatgcgccagaatggattagaagctgcgattttaaagaaagcaggggaagataagattatttttggcgtttgtggcggctatcagatgttaggagaaactctttttgacccggatggtgtcgaatccggtggaaagataaagggaatgggattgcttccgatggataccgtctttaaaggcgcaaagaccagaactcgcgtagaaggtcgatttttggaagtgaccggtgcactttctgctttaagtcagattgaattagaaggttatgaaattcatatgggagaatgtaccagaaaagagaatgcaaaaccgcttgtcacaataacagataaagtaaatggggattccaaagcagacggaacgtataaagacaatgtgtatggctcttacgtgcatggaatctttgacaaagaagaagtggcagaagcagttgtaacttcaattggaaagaaaaagggactcgatgtcagtgaaatgacaggggtagattttgccgaatacaaagaaaaacagtatgacctgcttgcggatggtttaagagaatacctcgacatggaaaaaatttacaagatattagaagaagggatttaattgtgaagacaaagctggagaatgtaaaaccaaaagaaattgaaacaagaagttttgaaattattaccgaagaattaggggataaaaaattacagccgggtacagagttgattgtaaaacgttgtattcatacaagtgcggattttgattatgcggataatctgtatttttccaaagatgcggttcctaaggcaattgaggcgattaaacacggggcatgcattgtaaccgatacgcagatggtaaaagccggaattaataaaaaagcacttgccaaatttggcggtgaggtgtattgttttatgtcggatgaggatgtcgcaaaaaatgcaaaatcagcaggaagcacaagagcagcagcaagcatggagaaagcggcaaaacttggaaaaccggtaatttttgcaattgggaatgcaccgactgcgctggtgcgtctgtatgagttaattcaggaaaaacagattcagccgtatttgattattggtgtaccggttggatttgtaaatgttgtacagtcaaaagagatgattatggaaacagatgttccttgtattgtagcaaagggaagaaaaggtggaagcaatattgcagcctgcatctgcaatgcattgctttatatgattgacaatgaaagagattactggaaataaaatttgaacgcagataagcggattgcaaatgtccgctttacgtgagtagatgcaatagatacggaggtgataaatcttgaagtgcgaacgatgtggaaatcagctcgatgataccgatttattttgcccaaagtgcggaaaagcagtatttgaagagtatatggacgatgatgacatctgggatgaatatgacagagaaccaaaggttggatcgaaagaaaaattagaaatttcaaaagagattcaaccggagaaagcgtcaaaggtcgaagaaaccaaagaaagtccgaaagaggaaaataagcaggaagaggcggcgaaaatgccgcagattccaaaagaagaatccaagccaaaaagaaagacagaagcgaaaaaagcagacaaaaaaacaaagaaaacaacaagcaaaaagaccgaagaagtgtccggtaagaaaagtccggtgggattgatttgtgcctgtatcctgatggtatgtcttttgattggggtgctctggggaatgatgacggtcagacagatggagaaggagcaggcgacaaagacaacggcagataatagtcaggaacaggaaaatcaggcatcggtttcaaccgataatgcgaagacagaagagacaacgaaaccggataaggcagaagaagcagagcaaaaagagaatgagactaaaacagaagagcaggaacaacagccggaagcgaaaccagaagaagtagagcaaaagaaacaggactattttgttatggcggacaaagagggcatagattttagtcaatatacaaaacttacagttgcaaatgcggaacagagttccatggcaagttccggcaactatgattacagtgcgaagagtgcagcagatggagatattacttcatcctggcaagaaggtgtagagggacttggcgaaggaacaggaatcaaactcagcttagatggaacacataaaattcgttatatcgtattatatctcggaaactggagaagtgatgagatgtggcagaaaaatgcgagaccgtctaagctaagtatcaatttgggagacaatcaggcgaaagatgtagaattctccgatgaaaagaaagcattttgtctttcttttgatgagccggtagaggcatcttttgtttccctttacattcaggcaggttatgccggtgcaaagtggaatgacaactgtatttcagaagtggaattttatgaataaaagaatgagcgagaaaggattgattatcctctactcgctcatttttgttattgttcaatggtttttaaatgttctacaaacaactcttggattccgcggtattcgccgagtccttttaaaatcggtgttactttataaccggctgctttgaatttattataccaggaatcagggtcatctcctgccatatcattctttgcgtggtcaccggctacaatcataaatggagcaagtacgatttcttctggcttataagcgtctacaaggcgttttaagctgtcaattgatggataggcttctacggtagcaaggaagatatttggatgtcccttatccttaaatgcataatccagagcagcgtaaatagaatttgaaaaatgagttgtgccgtgtcccataaagacgagtgcctgttttttattcagccaggagaattcatcggctaaaatttcaatgactttattggtatcttcttcagaggtaagaagtggcgcaccaaatgaaatggaatcaaaagaatctttataggcaagcgcatcttctttcattaaatcattttcaattccattgataacgtgagttggctgtaccaggacattggtgattccatcctgcttcatctgtttcattgcctcagatacagtcataatgtgtacattgtctctggcatttacttttttgatgatcattttactggtccatgcacgatataaagaagcattcggacatgcattttttaaagcttcttcaatagcgtcaatggtgacttctcttgtgtcattgtggcttgtaccaaagctgacagcaagaattgcggtttttctttctacgtttgttttcatagttcctccctattgtgtagtattgatatttgtatcggaaatatatttttccagtgtttttaaattttttggaagcggaagagttgtctttaaaatttgtttttgacaaagactgtgaaacagttctaacacagcgggcggttccaaatttgttttttcaagcacacgaggatttgaaaaaacttcttccggtgcaccttgcattaaaacttttccctgatgaaataaaataacctggtctgcccattcataagcgtagttgacatcatgggtagccatgaaaacagtaattccggatttcgtcatgcgatttacaatttgatttaccatagtagtatgtttcggatcaagagcagcagcaggttcatctaaaataataatatccggtttcatcacaagaatatcagcaatagaaacctgttttttctgtcccccgcttaaagcatgagtaggtttatgacgaaatggtgtaatttcaagctcagcgattacatcttcaaccgcttttttggcgtcttcctcagagtatccgagatttaatactccaaaggaaatttcctgatatacgctcgcagaaaagagctgattgtcggggtcctgaaaaacaattccgattttgcttcgaagttttagaagccctttacggtcataagaataaggttccccgttataataaagagttcccgaacttggtttgtgaattccggtacagcagaggaaaaaagttgattttccggaaccatttgcacccataaatgcaattttctggcctcttggaatctccagggaaagaccatttaaagagtgtgttttttcatcatcataagaaaaatacaaattatctgcttttaagatgatatcattattgttcatgcaaaaaatttcctccagataaaaagaattaaaagaaacagttcaaaaagtgtaattaaaaaaattacatgttttttcggtggttgattttcatttaaaacgcgaatcgtgccatcatagcagcgggtttccatggagttataaagggcattggaacgttttactgcccgcaccataagggtagaacacattgctgcaaaagactttagcgaagttttatagttgcagtttccgagtcggcagtcctgagcagtagaaatatgataagcagtgtctaaaagcacgaagataaagcgataaattaaaagcattaattcaattaaaagttttggacagtgaagcttatcaagtaccattaaaatatcaggcattggtgtattcagagaaaggaaatacaggcaggatacagcagcaagtgcagtcaggattaattgaagggcataaaatgcgccatacgtgcttccggttaagtaccagtttccgatttttatagcaaataaatcgagtggtttttgtttcacgtttacaagaatcgccagtgtactcaaaaataaaaatgccagtggaacacttaagaaatgaagatagcgaaaaagggggattccacctttccatacagtgagaatccccgttactgctaaaacaattcctgcaattaccatggaacgactcattacacagataattaatgtaatcacggcaaaagcgaatttttctgcggcattttcatatctgagtctggaagtataacaaagtttatcaattgtaatcattcaagactcctttcttgtgacaggcgaaagaatcattcaccctttccaagctttttacgctctacaaaacgtcccatgaagaaagcaaggacgccgacaccgatagaagactgtacacagaacagtaaactttctacctcacccggaagttcatgtccaagcattttttctaaaattggttctgcaattggctggaaagaagagtcgacttcttcaacaacctggcttccggcatcatcagatccgccgaattcagcatcctttaaagcaaataatggaataaaggcaattaataaaataataaccaataaggtaatgactttctttttcatattattttgcctccttcataaatccgattgcacgaagctccggttttgcataagtttcaagtgccataatgattaatacagttaagataccttcgataattgcaagcggtacctgagttggtgcaaatacaagtaagaatttacccattgcatttaaaatggttgtatcagcgtgatgagcaagtgccatctgaactgcagttacacagtaagtaaataaatctcctaaagttgcagataagaaaatagcaaccattttatttactttgcatttctgacagactttataaattgcaaaggttacaaatggtccggcaattgccatggagaacgtgtttgctccgattgtagttaaaccgccgtgtgcaagtaagattgcctggaataataaaacaataattccaagaatggaaactgcacttggtccaaataagatagcgccaagaccggttcctgtcatatgagaacaacttccggtaacggaaggaattttcaaagaagagataacgaatacgaaagcaccggacatagccaataaggtaatcaggttgcggtgttcatttaatgttttcttgatggagaaaaatccggctgcaagaaatggcagacaaaggactccccaggcaacgcagtatcctgcaggaagatagccttccatgatatgcatagctgctacgtttggaacaataccaaacataagtgcaaatgcggtagcaaatgcgatgacgtgtttttgttgtttgttcattttcatgactcctttaacgtgataaagatttaaaataaaaaaacctgcggaagaattccggcaggccaagttgagaataaaaaacagactacgactgtgtagagtgttttcattcttacacaaggccatcgttcgtaaccatgtgtaaatcgtatgcagcaggcaggtcttctgacttaagcgtcattgcagcatttcgccttcccggtttcccagtggcaatgatgaaatgtgctctgctagttacagcggcgtgaccgtgcgggaattgcacccagctttcctattattccgaaaaaaacggacacctgtgtacattcaattctttgtccattgtattatttctcaaagcatttgtcaattcatttttaggcaaaaaccgacaaaaaaccttaggttgcaccgaggtacattctgtgctaagatgaaccaaggataagcgagaaaaagcttaaaaatataagaggcggagtgaagagaaaatgagtatttccatgattggaatcgatcacagcaaagcatctgtagatatccgtgcaaagttttcttttacaaagaaaagagcaatagaggcaatgaaaaagttaaaagaagaacacggtatcttaggatgcattattttatccacctgtaaccggatggaagtttgggtcagcacgcaggatgacgaagaaatttctctgtatgattttttatgcaaagaaaaagaagtagaaaaagatgagtatcaggattattttatgaaacgtgaaaatgaagaggcagttcggcatttgttttatttaaccagtggattaaaatcgcagattcttgctgaggatcagattattacacaggtaaaagatgcgctgactttagcaagagatgcctattgtacagataacgtacttgaagtactgtttcgtatggcggttacagcggcgaagaaagtaaaaacagaagtaacgttttcaagagccaatacttctgtgattcatcaggcaatggaacgcttaaaaaatcagggattttcgtttgagggaaaaacctgtatggtaattggaaatggtgaaatgggaaaagtgacggcacttgcgttaaaagaagccggagcagacgtaaccgtaaccgtacgtcagtatcgaagtggtgttgtaaacattccacagggatgtaaacgcattaattatggagaacgaatggaacttcttcctgattgtgatctggttgtttcagcaacagccagtccgaattataccttgacaaaagaaaactttgaggaaattaagttagatgcagcatctgtcgttttaattgatttggctgttccaagagatattgaccctgaagtaggaaaattacaaaatgtttccttgtatgatattgacagtttccgaattgatgcagcgtctccaaaacttcaggcgagtatgcaaaaagcaggagaaatcttggatgaccagatgaaagaattttatgactggtttaatggcagagatattttcccgaggattgaagagattaaagccgatgccgtagaggatttaaacttacgaattaccaaaattttaaaaaagactccaatggaacaaaaagacagagaaagccttttaagagcgattgatacggctgccggaaaagtggtaaataaaatgattttcgggcttcgtgattctctggaacaagaagcatttttagactgtgtggagggactggaaaaaatatatgaaagctgatgaaaaaaaatattttccgatgtttgtggatttaacacagaaaaaagtaactgtgattggcgcaggtaatattgcaaaacgaagaattgaaactttgctttcctttgccggtacaattgaggtgattgcaccggatgcctgtgaaagaataaaagaactggcaaaagagggcagactggtctggaaagaaaaagcgtatgacagggaagacttatatgatgcagatttagtgctctccgcgacaaataatgaaaaggtaaacaatgatgtttacagtgcatgtaaatgtcttgggatttcagtcaatatagcaagcaaccgaatgaaatgtgatttttattttccatcaattcttcagaaagaagaaacagtgattggattaaatagtgcaggaaatcctgcaaaaacaaaaaatgtgagaaaagaaatgcaaaaatggatagaagaagcaggggagaagcatgagtaaaaaagtgataattggcagccgtgagagccggcttgcagtaattcaaagtgagatggtaagagattatatcctttcttataataaagactgtgaagtagaactgctcacaatgaaaactacaggagataagatattagaccgtacgttagataaagtgggaggaaaagggctgtttgtcaaagaacttgacaaggcgttgttagaaaaaaagagtcagctttcggtacacagcttaaaggatatgccgatggaagtaccggaagaacttccgcttttagcattttccaaacgagaagacccaagagatgtactggtacttccggaagggatcaaagaactggatgaatcaaaaccgattggctgttcaagtctcagacgaactcttcagctaaaagagctgtatccgaatatggaatttaagagtgtcagaggaaatgtacagaccaggcttaagaaattagatgaaggacaatatagtgcgcttgtgcttgcagcagcaggattgaaacgtctgaagctggaaaatagaatcagccgttattttgaaccggaagaagtgcttccggcagcagggcaggggattttggcaattcagggaagaaaggatgaggattactcttatctggatggctataatgatgaggatagtgaatgtgcagcacttgcagagcgtgcctttgtgcgttacttagatggtggttgttcttctccggtcgcagcacatgcaaaagtagaaaaagacaaaataattttgaccggtctgtattatgaagaagaaagtggtgcatggagaaaagcaagtcttagaggaaaaagggaagaagcagaagaacttggaatccgtctggctaagcagttaaaacatccggggaaagtatggctggtaggagccggtcctggagatattggactgtttaccttaaaaggaatggaagtattaaaaaatgcagaagtagtggtatacgatagtctggttggacagggggtgctttctaaaattccaaagggagtacgtctgattaatgttggaaagcgtgcttctcatcataccatgccacaggaacagattaatcaggtacttgcagaagaagcaaaaaaaggactgcgtgtggtgcgcttaaaaggtggagacccatttttgtttggaagaggcggagaagaattggaactgcttcataaagagggaattccttatgaagttgtgccgggtgtgacttcttcaattgcagttccggcatataacggaatccctgtaacacacagagatttctgctcttctttgcatattattacgggacataagaaaaagggcgacacttatgatattgactttaaagccttagtaaataccaaagggacattggtatttttaatgggagtcagtgctttagaagatatctgtaattctcttttgcaggcaggaatggatgaaaagatgcctgctgcaattttgcaaaaaggaacaacagcaggtcaaaaaagaattgtggcaaccgtcagtaccctcgcagaagaagtgaaaaaacagggaattgagacaccagccattattgtagtcggaaaagtatgtgcccttgcagatgaatttgcgtggtatgaaaaacttccactctttggctgtaaagtacttgtgtcaagaccaaaagagacgatttcttccatggcacataaactgcgtttattaggagcagaagtactagaacttccggcaattcgtaccgagccattagaagaccagagtttgttaaaagaggcattgaaagaactggattcttatcagtggattgcgtttaccagtccaattggcgttaaagtattttttgatgaaatgaaacagaatagtgtggatgtccgtaaattggggcaggtaaaaattgcttccattggaaaaggaacaagaaaagccttagaagaaagaggattatttgtagatttgatgccggctgtatttgatggagattctcttggaaaagcgttgtgtgaagcctgtgagggaacagaaaaaattctgattccgagagcaaaaattggtggaaaagagattttagcacagttagcaaagaagccggggcttattgtaaatgatgtaccgacttatgataccttttatgaagaacaggaaatcattgacattaagaatctatttgaaaatggagaaattcagaccgcagtattcacaagtgcttcaacagtaagaggatttgtgaatgcagtttcggggcttgattttgagaaagtaagagctgcttgcattggaaaacagaccaaggcagaagccgacagctatggtatgcagacatttatggcaaaagaggcaaccattgacagtgtgacagatttggttgtagacttaaataaaaaataggatattctcagaattcgagagtgcccgataagtaaaataaaggagtgaagacctcatggatatgacaatccgaccaagaagattaagaaaaagtgaaacgctgcgtaagatggtacgcgagacaagaatggataaaagttctttgatttacccattgtttgtaaaagagggagaaaacatagaagaagaaatcccatccatggaaggacagtatcgttatagtattgaccgtctgccttatgaattagaacgcctgcagaaagcaggagttgataaagtaatgttttttggaattccggatgtaaaagatgaagtaggaagccaggcctatgcagaagacggaattgtacaaaaagccattcgtgaagcaaaaaaacagtttccggatatgtatttgattaccgatgtatgtatgtgtgaatatacctctcatggtcattgcggtgtactttgcggacatgatgtggaaaatgataaaacccttgaattacttgcaaaaacagcgctttctcatgtgcaggcaggtgcagatatggttgcaccgtctgatatgatggatggaagggttgcggcaatccgccatattttagatgaaaataattataaagataccccaattatgtcttatgcggtaaaatatgcttctgcattttatggtccattccgtgatgcagcaggttctgctccatcctttggggacagaaaaagttatcagatggatttccacaacagaagagaggcaatcaaagaagcactcttagatgtggaagagggcgcagatattatcatggtaaaaccggcgctgtcttatcttgatatcattcgtgaagtcagagatacgattgaccttccggttgctgcctattcggtaagtggggaatatgcaatggtaaaagcaggagcaaaattgggatatattgacgaagaacgaattatcggtgaaatggcagtcagtacattccgtgccggaacagatatctatctgacttattttgcaaaagaaatcgcaaaacttatggatgaagggagaattggataatggcaaaatcacaagaattatttaaacgtgcagtaaatcgaattccaggcggagtaaacagtccggttcgtgcttatggggcaatcggtgagactccaagatttatacagggagcagtaggaagcagtatttttgatgtagatggacagaaatacctggattatatctgctcctggggaccgatgattttaggacataatcatccggtgattcgtgatgcggtagttcgtgcctgtgaaaatggattaagttttggctgtgcgacagaacgggaagtagagatggcagagtttatctgtgagagaattccgcatgtagagatgattcgtatggtaaattccggtacggaagcagtaatgagtgcaattcgtgtagcaagaggatttaccggaaaatcaaaaatcattaaatttgcaggttgttatcatggacactccgatgcactcttagttagtgcaggaagtggagttatgacaagtggagtgccggacagcgcaggtgtcccaaagggctgtacacaggataccatgattgcagtttataatgatttagagagcgtaaaacagcttttagaggaaagcaacgatgaggtggctgccgtaatcgtagagccggttggtgcaaacatgggtgttgtaccgccaaaagatggatttttagagggactgcgtacgctttgtgatgaacataaagcactgttgatttttgatgaggtcattaccggattccgtttaaaattcggaggcgcagcagaatactttggagtgacaccggatttggttacttatggaaaaattatcggtgcaggtatgccggttggtgcttatggcggaagaaaagaaattatggaaatggtttccccggcaggtccggtttatcaggcaggaacgttaagcggaaatccggttgcgatggcagcaggtctggcacagttaaaactgttatgggaagatcaggatgtctataccagaatttaccgaaaaggggagtacctgtttgaaggaatccagaaaatcttaaaagaaaatgaagttccttatcaggtcaactatacggcttctcttggttgtatcttctttaccagtgaaaaggtaacagattataccagtgcaaaaacagcagatacaaaagcctttgctgaatactttaagtatatgctcaatcatggagtacatcttgcaccgtctcaatttgaagcaatgttcctttctgatgcgcatacacaggaagaactggacttgactttggaactggttgagcagtattttaaaacatggtagagtctatgacatcaacacaagttgcatgcggagcgcttctcttatttgtatttgcactcgtctggtcaatggtaagggaaaataacaaaagaaaaaagaaatttctcgaaaaaataaagaaaagctggggagctgtcccaacacgggaatatagctgggatgagttagagcagatatcggcttatcataaagcacagccaaaaaacagctttgtgatagatgagattacctggaatgatttggatatggaccggattttcatgttgatgaatcagaccgtatcgtcggcaggagaagactatctttatgcaatgcttcacagaccggaattttcagaagagagattaaaggagcgggaacggctgttttgtttttttgaaaaagaagaaaagacaagaattcgttgtcagcagattcttacaacgcttcgtaaaccgagaggactttctttgtatcagtcaattcatgttgaaaaagactgccaagttggctcgccgatacgggaaattctttcgtgcgtgctcttttttgcatcgcttgtcgcatttatggtagttcctgcttatggagtgtttgcatttttagcagtgagtggaatcaatattatcacttatctaaaagggaaagaagagattaaccggtatttgggtggatttcgcagcgtgatgcagttaatcggatgtgcagacacactggaaaaggcaggaatttcggagctttcagagtatacaaagaggttaaaagactgtaaaaaggcactgggcagttttagaaaaggctcgtttttagtagtcaaccatgatggaatggaaaccggtccggaagcggtgatgcttgattatattcgaatgatgacgcatattgatttgattaaatttaattcgatgatgaaggcaatgagagagcatcaaaaagaaatcgaagagatgatagaaatttttggactgttagatgcctgtatttcaattgcatctttccgggaacttctgccgtattattgcagtccaaaatttgattccgataaaaagagggcagtattagacgtagaaaatctgtatcatccgttgattttggaaccggtggcaaacagtataaagacaacgcaggcggtgcttgtaacaggctcaaatgcctctgggaagtcaacctttttaaagatggttgcaatcaatgcaattttggcgcagaccattcatacctgtatggctacagaatgtaaaatgtcttattttcgtgtgatgacgtctatggcactccgggatgatttggaaagcaaagaaagttattatattgtcgaaattaagtctttaaaacggattttagattccgcaaaagaagaaacacctctgctttgtattgtggatgaagtacttcgtggaacaaataccattgagagaattgcagcttcttctgaaattctggcctcgctttgtcttccgcatgtcctttcttttgcagcaacacatgatatagaactgacttacatgttggaagagtattatacaaattatcattttgaagaagaagtaaaaaaagacgatgtcaaatttaattatcttctaaaaaaaggaagagtgaccacaagaaatgcaattcggcttttaaaaatgacaggatatgacgattcaattgtagaagcttcaaaaaatgcagttgtccgatttgaacaagagggcagttggaagaaagtaggagaaaattagatgtttgtaaagatatatacggatggtgctgcaagaggaaatccggatggaccaggcggatacggatgtgttctgcattacaccgatgcaaagggagaactacatgaaaaacggttatcaaaaggatatgtgcggaccacaaacaaccggatggaactgatggctgcaattgcaggttttgaagcattaaaatgtccctgtgaagtggaactttattcagattctaaatatttagtggatgcgtttaatcagcactggattgatggatggttaaaaaagggctggaagcgtggaaaaaacgaaccagtcaagaatacagatttatggaaacgtctgttaaaggcaaaagagcctcataaagtaacatttatatgggtgaaaggtcatgacggtcatgaaatgaatgagctttgtgattttctcgcaaccacggctgcagatggaacagatttaagtgtggatgagggaatctgataaaaatcagggaagtttcggattttgagaaaagaatatttcttgaaacctgaaacttcctgtgctattataaaaaacaaacgtgttacacttttatatattttttaaagtggaaacatttggaaacatcaggaggtagaaccgtgcagaaatacggagtaaacgaacttcgaaaaatgtttttggagttctttgaaggaaaaggccatttggctatgaagagtttttctcttgttcctcataatgacaagagcttattattaatcaatagtggtatggcaccacttaagccatattttacaggggcagaagttccgccaagaagaagagtgacaacctgccagaaatgtatccgtacaggtgatattgaaaatgtaggaaagaccgctcgtcatggtacattttttgaaatgcttggaaacttctcttttggagattattttaaaagagaagcaatccactggtcctgggaatttttaacagaagttgttggacttgacccgaacagattatatccgtctgtttatcaggaagatgatgaagcatttaaaatctggaatgaagaaatcggaattgcaccggaaagaatcttccgttttggaaaagaagataatttctgggaacatggtgcaggtccttgtggtccttgttctgaaatctattatgacagaggggaaaaatacggttgtggaaaaccaggatgtacagtaggctgtgaatgtgaccgttacatggaggtatggaacaacgtatttactcagtttgaaaatgatggagaaggacattataccgagctggttcagaaaaatattgataccggtatgggactggaacgtcttgcagtcgttgttcaggatgttgattctatctttgacgtggacaccctttgtactttaagaaataaagtctgcgagttggcacacgtagaatatcagaaagatgatgcaaaagatgtttctatccgtctgattacagaccatatccgttcttctacctttatgatttcagatggtattatgccgacaaatgaaggaagaggttatgtccttcgtcgtttgattcgccgtgcagctcgtcatggtcgtcttcttggaatcgaaggaaaattccttgcaatcttaagcaatacagtaattgaaggttcaaaagatggctatccggaacttgaggaaaagaaagactttattttccaggtattaaccaaagaagaagaacagtttaataaaacgattgaccagggtcttcgtatcttagaagagttagaaacggaaatgaaagaaaagaacgagaccgaactttccggtgaaaatgcatttaaactgtatgatacttatgggttccctctggatttaacaaaagaaatccttgaagaaaagggatataccattgatgaagacggatttaaatctgcaatggaagaacagagaaacaaagcacgtacagcacgtgaagtgacaaattacatgggagcagatgcaacggtttatgaccagattgatgcagaggttacaactgaatttgtaggttatgatcgtctggtacatgaatcaaaagtaactgtacttacgactgaagaggagctggtagatgctttgacagaagaccagaaaggtacgatttttgtagaagagacaccattttatgcaaccatgggtggtcaggaaggcgatactggtgtgattacctgtaatggagcagaatttgtggtagaagataccattaaactgcgtggcggtaaagtgggtcatgttggaaaactgacaaaaggtatgattaagacaggcgatgttgttaccttaagtgtcaatgcaaaagaacgtgctaatacctgtaaaaaccacagtgcaacgcatctgcttcagaaggccttaaagacggtacttggtgcacatgtagagcagaagggttctttggtaacaccggacagacttcgttttgactttgcacatttccaggcaatgactgcggaagaaatggaacgtgtagaagcaatcgtaaatgaagaaattgcagagaatctgccggtagaaactcagattatgagcattgaggatgcaaaaaaatccggagcaatggccttgtttggtgaaaaatatggagatagcgtgcgtgtggtatccatgggagatttctcaagagaactctgtggtggtactcatgtaccaaatactggtgtgattacaacctttaagattgtatcagaagctggtgttgcagcaggcgtacgacgtattgaagcgctgactggtgatggtgtattccattactataaagaagtagaaaagaaattaaatgaagcagcaggtgctttaaaaaccacaccggctgaagtacttgaaaaaatttctcatctgcaggcagaaatgaaagcactgcacagtgaaaatgaatccttaaaagcaaaaatggcacaggatgctgttggcgatgttatggaacaggtaaaagaaatcaagggagtcaaattccttgctgtagcagtagaagatgttgatatgaacggtctgcgtgacttaggcgaccagatgaaagaaaaaatcggcgaaggtgttgttgtgcttgcaagtgtaaatggaggaaaagtcaacctgcttgctatggcaacagactctgcgttaaaagcaggggcacatgccggtaatcttgtaaaaggaatggcagctgttgttggcggtggcggcggtggtcgtccaaatatggctcaggccggcggaaagaatccggaaaaagtaccggaagcacttgaaaaagcagctgaaatcttagaagaccagattaagtaagaaaaattttaagaaattttcataaaatagttgacgtatgagaaaaatctgatataatgtttttgtgcaataaaaatacccagacagttgtattatgcacaatctacaactggagggaggttaggtgtgagactatgtcaaatgtaatcgtaaaagagaacgagactttagatagcgctttacgtcgtttcaagcgtagctgtgcgaaagcaggcattcagcaggaaatccgtaaaagagagcattacgaaaaaccaagtgttcgtcgtaagaaaaaatctgaagcagctagaaaacgtaaatataattaatgtgcagtaaaagcctctggtaattcccagaggcttttttactacagcgattaaggaagcagaaaagcatgaagaaactgattgatttgatttccagccgtttttttgtatttgtatttgcagtgttactgcaggtgatatggttgttactgatttcgtggggaatgagcagtctttctgcaccggttacaatgacagcagatattttgagtatattattggtattatggattgtaaataaagaaattaatccgtcgtacaagttggcctggactattttgattttagtacttccggtatttggaatggtcgtatatttgttatttggagagtcaagagttgcaaaaaagatgacagaagagtcagatgcagttgtacaggaaattgaaaattatttcagggaaaatgataaagtaagagaaaaaatagaggctttggatgaaggaatttccaatcaatccgcttatatcagagattatgcaaagtttccgcttcatagtcatacttccaccaggtattatccgctgggagaggcaatgtttttggatatgctggaagatttaaaaagggcaaaacattttatttttctggaatattttattatccatgaaggtaaaatgtggaactctattctggagattttagaacaaaaggtaaaagagggcgtggatgtccgtctgatttatgatgatatgggctgtgttacgacattaccgcaccgatattataaaaagcttcaggcaaagggaatcaaatgtgcggcatttaatccggttcgtccaattttaaatattgtattaaataaccgtgaccatagaaaaattctggtgattgacggacataccggttataccggaggtattaatctggcagatgaatatattaacgaagaaatccgatttgggcattggaaagatacaggaatccgcctgtatggagaaggagtatggaacctgactgtcatgtttttacagatgtggtcgattatcacaggggttcgtacgcatataccggcgtacagcccttatgtatttcatacagaagaatttgaatcagatggttttgtacagccttatggggattctccgatggataatgaaacggtaggagaaaatgtctatttaaacatcattagtcaggcaaagaagtatgtgtttatctgcacaccgtatttgattattgacaatgaaatgatgatggcattatgtctcgcagcaaaaaaaggtgtggacgtgaggattattacaccggggattccggataaaaagatggtctttcttttgacgcagtcttattataaacagttaatagaagccggagtacgtgtgtatgaatacacacctggatttgttcattctaagacctttgtatgtgatgacgaaattgcgacagttggaacgataaatctggattaccgcagtttgtatctgcattttgaatgtggggtatggatgtatcaaagccaggcagtgagagaagcaaaagaagatatggaagcaacacttccaaaatgtaaagaagtcagtctggatttttgcaacaagagaaatatttttgtaagaggaatacagagcattatgcggctgattgcaccgcttttatagagtgtgtgcttaagaaaaactttgagagtgcacaaaaggtagaagtaagcaaagaagaatacagggggaaaagtatgctgatgaacttttttacccgtgccgttttgggtacggatttttaccatattattcaatggtttctggtttatggaattttgggatggattgtagagtctgtttatatgtcaatctgtaatcgaaaactgaccaatcgtggttttacacatggaccgatttgcccgatctatggatttggggcactgacagtttatttcctgctgcgtccgtttgcaggaaatctggttctgctttatattatgggctgcattgtgccaactttactcgaatatttgacagctcaggtgatgttgtttatatttggggaagtctggtgggattataacgaaaaaccatttaattataaagggattctctgtctggagagcaccattgcctggggcttttatacagtaggattattcttatttttgcaaaatgcagtagaacggtttgttgacagttattcatttgaaattggctgtgtggtaagtacatttagtattatgctgtatatggttgatttttcttacagtttttatcaggcaaaaaagagtgaccttccagagggaatggaagcattttggacgcagattaaagaatggttttaaaagaaaaaaattgagtaagttccataattaaagaaagtgatttatcataaatcactttcttttttcataccataaaacaaggatgctctttggagagagcagatgataaataagattgtctcatacataatggtaatctgccttttctgtgccgttccacaggtagtatttgcagatgaaactgtgattacatctccacatgctgtcttaatggaagcctctaccggaaaaattatttatgaaaaagaaaaagatgtacaggtatctccggccagcattacgaaaattatgacgctccttttgatttttgatgaaatagccaatcaaaatcttgattttgaagatgaggtgacaaccagtgcttatgcaaaatctatgggaggttctcaggtttatcttgaagaaggagaaaaacaaagtgtagaaacgatgataaaatgtattgtcattgcatcaggaaatgatgcgagtgtggcaatggcagaacatatctgtggaagtgaaacagaatttgtaaaacggatgaatgcgcgggcaaaatctcttggaatggagcatacaaattttgaggattgttgtggactgaccgactctgacaatcattatacgacagcttatgatgtggcgctgatgtcaaaggaactgattacaaaatatcctaaaattctggactattcttcggtctggatggaaacaattacacaccataccaatcgtggggacagcgagtttggactgacaaataccaataaactgattcgaggatacgatggctgtgtcggcttaaaaaccggaagtaccagtaaggcaaaatactgtgtttctgcagtagcaaagagaaatggattgacgttaatcagtgtgattatgacagctccggattataaagcacgttttcaagacggcgcaacactgttaaatcttgggtttgctacctgcagtctttatgaagataagagcactgtgaaaaagaaagttccagttaaaaaatcagtacaaagagaaggaatttgtgaaaacaaaaaaaagttttcttatctggacacggaggggaagtccctttctaaaatagagaaaaaaatacaattaaaagaaagtgttgaagcacctgtaacaaaggggatgaaagccggagaaatacaatattatctggaaaatgaaaaaattggaagtatagacctcgtttttagtcaaaatatcgaaaaagcacgctacgtcgattacttaaaaatggtgcttgagaaatttttcagaaatagggattgaagtttaaaaaccattggattataatggctcatggtaaaaacgaaatgcagaaaaaggggaagaaaaaatgcaacaggatatgacagccggaagcccggccaaggccattttaatgtttacggttccgatttttgtcggaaatgtatttcagcagttttacagtatggttgatacaattattgtaggtaagtttgtaggaacaacagctcttgcagcggtcggaagtgtaggaactatcatgtttttaattattggttttatgcttggtcttactgcaggctttacagttttaaccgcacagcgttttggtgcgggagatatgaaaggcatgagaaaaaccgtcggaagtgcggcaacattgtcggtaattatgacggtaattatgacgaccatcagtatgcttgggatgaagccgttattaaaatttatgaatacgccatcagatatttttgcggacgcttatcactatattatggtaatttgtgcgggtatttttgcaactgtattatataatcttttggcaagtattttgcgtgcaattggaaacagtcagattccgttatattttctgattttatctgcactgttaaatgtagtattagatttattattaattattgtatttcgtatgggagcagcgggtgccgcttatgcaactgtaatttcacagggtgtgtcaggggttctttgtctgatttatattataaaaaagataccggaattaaaattagaaaaatccgattttcagttaaatgggcatattgcaaaagttcagattggaatcggaatcccgatggcacttcagtattctattactgcaatcggaagcatgatggtacagtcctctttaaatgtgttaggttcaggtgcagttgcagcatttacggcagcaaataaaatcgaacaggttttaacacaggcctatgtcgctcttggaacaaccatggcaacttactgtgcccaaaacattggtgcaggtaaagtaaaaagaatccgccagggatttcgtgcagcaacgattggaggatggatttactctgtcatagtaggtctgcttctggcttttgttggcaagtattgtaccattttgtttgtatcaggagatgcaactgcaatcatggatcaggtggatatttatttgaaatgtgtatctgcatttttgttcccgcttacgattgtaaacgtctatcgaaatggaattcagggaatcggttatggatttttgccgatgatggctggtgttgcagaacttagtggaagaggtattatggcagtgattgcaggaaaacagagaagttatcttggaatttgtcttgcaagtccggttgcatggatttttgcttccgttctgcttttagtgatgtatgtgattgtaatgaaacagcaggagcgtatttttgcaaaaagaggtcagaaataaaaagtttgcgagagtacataaaaaataagagagtacataagagaaattaagagaaaaaagtattagctgaggaatcggttaatgctttttttttgagcgtaaatgcgatacaatgatgtgagtgttaaaagaaaacaataaaaaacagacaaaattagaaagaaaaaatagtagaaagaataaagagcaggaaaataaaattgaaaaaatttaagattacaaattatgagataacttcagagaaaataagccaggaactgagatttgtgatgattagtgactggcataatgttatatttggagagagaaacaagccggtatttgaggcaattcaaaaaataaacccggatgccattttaattgccggagatttggtacttggaaaacaggaagcaccgcttttgccggcattagaaagtttaaaagaactgataaagactgcaccggtattttatgcacccggaaatcatgaacagcggatgaaacgttatccgcaaaattatgaagcttcgtttttggaatacgagacacagataaaaaagctgggggttcattatctggaaaacgaacaggaggttcttttggttaagggcgaaaaaatccagattcatggtctgaagctgccttatgagtattataaaaaaggttcaaaaaaagcaaaaacaggtccaaaggaagaagaattaaagacgctgcttggaaaaccggatgagaacgaatttcatattttattggcacatacaccgagatatgcaaaagaatattttaactggggagcagatttgaccttgtccggacattatcacggcggagttttaagacttccatttggtggaaaaggtgcattaagtccggattttgtgctgtttccaaaatactgttatggattatttaaaaaaggagaacaaaaattgattacgggttccggacttggggaacatacgattccaatccgaatcgccaatccgagggaacttgtggtgatttcctgcaagccaaagagaaagtagactttttaaggaaaatcatgtaaaattgtgtgagttgctttgcagtaaaaagattttaaccaaattaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgactctcctaagagtgcatgtaaaatattaaaatcatcgagatagacaagaaaggtgagaaagaatgggaattcccgtaaaacttacggtgtttgaaggtcctcttgacctgttattacacctgattgagaaaaataaagtaaatatttacgatattccaatcgttgaaattaccgaccagtatatggattacatccatcagatggagcgggaagatttaaatattatgagtgaatttatggtaatggcggcaactctgatttcgattaagtgcaaaatgctccttccaaaagaagtggatgaagagggagaagaaaaagacccgagagaagaactggtgcgtcagcttttagagtataagatgtataaatatatgtcctatgaactgcgtgataagatggcagaggcagcgaaaagcatctataagcttccatctcttccaaaagaagtagaggattataaagagccgatagacccacaggaattactggcaggaatgacgcttgcaaaactgcataaaatctttgaagacgtgttaaggcgtcaggaaaataagaaagacccgattcgcagcaaatttggaaaaattgagcaggaagaagtcagcctgccggaaaaaatgagtgatgtggaactttatgcaaggacacataagcagtttagttttcgtgaacttttgggaaaacaggcaagtaaatttcaagtggttgttacatttttagcaattcttgaactgatgaaaaccggaaaaatcagaatttatcaggaacatatttttgatgatattcaaattgcatcgttggtataagacaggaaaaataaatggaatgtgttctcagaagtcgagaatacatagaaaaatggggagaaaaaaatggatattgaacattatgaaggcgcaatagaggctctgctttttgcaatgggaaaatcggtcagcctctctgcgattgcaaaagcaattgggcatgatacagaaacgacccgcaaaattattgataatatgatgctttcttataatacggcaaaaagaggcattaagattattgaactggaaaattcttatcagatgtgtaccaaagaagagtattatgattatctggtgaaactggcattacagccaaaaaaagcaagtctgtcagatgtcatgcttgaaactctgtcaattattgcgtataaacagccggtgacaaagttagaaattgagaaaatccgaggagtaaaatgcgaccatgcaatcaataagttaattgaatacaatctgattcaggaagtaggcaggttagatgcaccgggacgtccgattttattcggaacaacggaagaatttttaagaagttttggagtacatggaattgaagaactgccggaacttgacccggttcagatagaagattttaaggcagaggcagaagaagagattcagctgaaactggatgtataaatttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgacggttaaggatatctgaaatttgacgtatgattttgagatgaaacgaaagttttgtgaaaaagttctgataaaagtgggacaggcatatattaataaaaaagtatgcagagaaaaatatgaaaaaaatcttaagcattactttcattttagtattcttttggggcagtattcaaaagaatctcctgcctgtctttggtgcagacaatcagagtcccggaacactttattcggaatccgcagttttgatggatgcagattcgggaagaattttatatgagaaaaacggatatgaacaacgaccgatggcaagcacaacaaaaatcatgacctgtattctggcattagagaacgggaaagaggaggatatcgttactgcttctgagtatgctgcatcaagaccgaaagttcatcttggagtaagaaaaggagagcagtttcgctttggcgacctgctctattctcttatgttggaaagtcacaatgatacggcggtcatgcttgcggaacatttagaaggtgatgtagagacatttgcggataaaatgaatcagaaagcaaaaaaaatcggatgcaggcataccttttttattactccaaatggattagatgccacaaaaaaaacaggagaaaatgagcaggttcattctacaacagcggcagatttggcacgaattatgcgttattgtattaaggaatctccccaaaaagaagcgtttttaaatattacaagaacgcagagctatacgttctgggatatagaaaaaaaacggagtttttcttgcaacaatcataatgcatttcttagtatgatggaaggagcattaagcggaaaaaccggatttacggcaaaggcaggctactgttatgtaggtgctttaaaaagagaagagaaaactttgattgtcgctctgcttgcctgtggctggccaaataataaaacgtataagtggaaagatacggtcaaacttatggagtatgggctgaatcaatacgaacaaaaatcattgttagagcagggaacattttcgctgccagaaacacttgtggtagaaaatggacaggcagagaaaattggaggagaagcaagtgttcccataaaagtgaaggctatacaagacaaaactcttttaatgcgaaaaggagaatcggttcgagtcatttatgagggaaagacaaaattgtcagcgccaataaaaaagggaagctgtgtgggaaatttaaagtatatcgtaggggactgcgtatatttaagccgtccggtttataccgcaaaaagtgtgaaagcaatcgattataaatggtgtctggaaaagattgcaaagcaatggacatttacttttccggataacatggtagaatagaagaaagagaaaatttaagaaacaaaaaaattaagtttaagaagaattaagaagaatgtactcttagaatggaggaaagaatgtcagtaacagtaatgagtttttccggagtctataaggaacaggaattttatcagagtaagcgaatagataagcgtgtggaagcagaacaggtggaagagacaaactgttattgtaccgaagaagcagaagaaaaaattaaaaagttgatagaatcttaccctgaaaaagggattcattttctggattcaggaaactatcattatgtgacaaaattctggatggaaaagctaacaaaaccatttgcactggttttgtttgaccagcataccgatatgcaggaggcagcgtttttcggacttctttcctgtggaagctgggtaagggaagcacttgaacaaaatgaactgttaaaagcagtctgtgtggttggacctccacaaaagtcaatagaagaggtttttaaaagcagcaaagaagaaccttggatagacaaagtctgttttgtttcaggagaagaattagaagcgcacagacaaacggcttatgacgaatttttaaaagaaaattctattccggtttatctttcgattgataaagatattttaagagaagaagatgcttctgtaaactgggaccagggaaagacaagtctcgaagaattactggcacttgtaaaaagctgttttgaaaaacaaaccattgcaggtgtagatatctgtggagaaaatgcgaaaaaagagggaaactgggaagtttcggaagttgaaaaaaacaacaagacaaatttgattctgttagaaacaatcggacagtggatgaaagaacaggaagtgaatcgttgaaaagggaagaagaattagaccggaaatttctgacaagcggtcaggaaaaagtaaaactggaaattgcattaatgcggtattttgaactggcaaaagataaaaataaagatttcttatcggaaatggaacagacttatcagaactatctgcttaagcggtttcgtccggcaatggaaaccttattagaacaaaaagagaacaaaaaaatgagacaactatttttgcaaaaaaagatgaatcaggggcttttagaagagttacttttgatggcatcaaaagcacataatacagaagcattcttatggcttttagaacaaaaacaggctctgtatgggtttgaaaaaggggatatggaattatgaggcaggcagaagaaatttctaaggatatctggaaactggcaaagcaggaaatttcttgtgcctgcccgttttttgctcctctattagaaaagatagaaattttggggcaaaatgagcgcaaaagttacggtctggatggattccggatgtggtatgaaccgtttgaacttttaaatacttatcaggagcagggaagaaaaaaaatcaatcgtatgcttctacacagcctgtttcatcttttgtatctgcatctggcagaaaaaaagcgggaggaaacacgctggaatctggcatgtgatttagtggaggaaacacgctggaatctggcatgtgatttagtgacagagtatacgattgactgtttaaaacttccgtatctgacaggagatgtgcaagcgcaaagaaaagaaatctatcagaacttctggaaagagggagagggaaaaacggcaggacaaatttatgaaagtttgagccaatattcagacacagagataaaaaactgggagcggatttttgcatccgactctcatgaactttggcgcaaactgaccgaagaagaaatagaagggttaaaaacacagtgggaaaaaatcattgcaaagactggttcagaagggggatttagtaaaaataaagcgggcatgcaaaaagggacaacaaaagagtggtatgaactgcaaaagaagaaaagacgggattatcatcgatttttacagcgtttttcaatcaaacgggaagaagtacaggcagatttggatagttttgattatattccgtatcattatggactctgcatgtaccaaaatatgccgtttattgagcctttagagtatacagaaacaaagcggctggaggaacttgtcattgcgattgatacctcaagttcctgttcaagagaaatggtgcagttttttttagaggaaacagcagggatgctgggaaatcaggaaaatttctttaaaaaatttacggtttatctaatccagtgcgacagttttattcaggatgtggtattaattacaagcatggaagagtggaaacgatacagcaggaaaataaaaattcagggaagaggcggaacggattttcgaccggtatttgaatacatagaaacgttaaaacaaaagaaaaaactaaagcatctcaaaggattgatttatttttcagatggagatgggatttttccgaatcaggaaccggattatgaaactgcgtttgtgtttttaggagaaccaaaagaaaacgtaaaaattccaaaatgggttctttctttaagtttaagcaggacaaaataaaattaaatttcaaagtctggaatagaaagggtctaaatatacagaaaaaaagaaaagaggaaaaaagatgaacattgcgcaggcaaaagaagaaattaaaaatactgtacggatctacacaagaaaaaatgaagacggaagttataaaatagctcccgttcatcagcgaccggtgctgttgattggacctccggggattggaaagacagcaattatggaacaggtggcaaaggaatgtgagataggtcttgttgcctataccattacacaccatacgagacaaagtgcagtaggactgccattaattaaaaacgaagtatttggtggaaaagaatacgcagtgaccgaatatacgatgagtgagattattgcatcggtttatcagtgtatagaaaaacagggatataaagaaggaattttatttatcgatgaaattaactgtgtctcagagacgcttgcaccgactatgcttcagtttcttcagtgtaaaacatttggcacacataagattccggatggctgggtcattgtggcagcgggaaatccgccacagtacaataaatcagttcgagagtttgatattgtaacattagaccgtgtaaaatggattgaggtaaaagaagattattctgtatggagaaattatgcactcaaaaataaagtacatccatcgattattgcctatcttgacttaaaaaccgaacaattttataaaatcgaagccacggcagatggctatgcatttgtaacggcaaggggttgggaagatttatccagaattttatggatgtatgaagaattagagcttgagattactgtagaatttttatttgaatatcttcagcacgaagaagttgcaagaggttttttaggattttatcagctttgtaaaaggatgaaagaagaatatgggctgatgcagatactagagggaacgataggtgaagaaaagttagagaaagaaatttttaaactcaaagagacagagtttgatgcaagagttgcaatcctgacttttttgagtgatggaattcatcaaaaaatagaaagttatgataaaaaagaacagaaagtccggattcagtatcaggaagcaaaaacacttctggagcaattagaaaacaaaaaagagacagatcgtttttctgaactgttagataggaaaattgagcaggaaaaacatgcttttttggtaaaaaaagagcagggcttactgacaaaagaagagaaatgggaaaaagaacaacaaagagaatggcttgaggaattaaaaaatgcgtggaaacagtctggaacgaagagcggaacagaacaagaactcattcgtgcctgttttaatcagaaaagagaagtacaaaaacaggaaaaagaaaaaatgcaggaaattttagaacgagcttttgactttgcggggcgtgcatttggagatgggcaggaaagcgcaatgtttgtggagcggctctcgatggatgaacgtattttaaaatttattcaaaaaaatggatgtagtgcatatcaaaaagccggagcatgcatacaggcagaagaacgtgaagaggaacttcaaaacgaaatccagaaattgacaaatttcttacaaaaataacttgactatttttgtccgatttattataatacacttaacgagaaaaattatcaaaacaaaaacagaaattgaatctggataaaaaagttgagttacaggaggaaaaaaagaatgaatggatgttttggatgtaacacatgtgcaagtgcagataaaccactggagggatttatcagaaacctgccaatggaaacttctcatcatagagtagagggacagagtacaaaatgtggatttggacttcagggagtctgttgtcggctgtgttccaatggtccttgtagaattaccccaaaagcgccaagaggaatttgtggtgcaacggcggacgtcattgtagcacgtaattttctgcgtgcagttgcaagtggttccggctgctatatccatatcgttgaaaataccgcattaaatgtaaagaaaacagcaatggaaaaaggagaaatcaaaggagaacgttcccttaaaagacttgcagatgcatttggtgtccagggaaaagataaatgggaaaccgcacagattgttgccgaaaaagtaattgctgatttatataaaccagaatatgaaaaaatggagctggttgaaaaattagcttatgcgcctcgttttaaaagatggcaggaacttggaattctgccaggtggggcaaaaagtgaagtgttccatggtgtggtaaaatgttctacaaacttaaactcggatcctgttgatatgctgacagactgtttaaaacttggtatttctacaggattatatggattgaccttgactaatcttttaaatgatgttctgcttggagaaccggaacttcgcatggcaccggttggactgcgtgtaattgacccagattatattaatattatgattaccggacatcagcacactatttttgttgatttacaggaaaaactgatttcaaaagaagcagtagaaaaagcaaaagcagttggtgcaaaaggctttaaattagtgggatgtacttgtgtgggacaggatttgcagcttcgtggttctcactatacagaagtatttgatggacatgcaggaaacaactataccagtgaagcagtccttgcaaccggtgcaatcgatgcggtaatttctgagtttaactgtacccttccgggaattgagcctatttgtgacagtttaaaaatcaaacaaatttgtctggatgatgtggcaaaaaaagcaaatgctgaattaaaaccatttgtatttgaagaacgtgaaacacaaagcatggaaatcattgatgaaattatagaagcttataaagaaagaagaggaaacgtagaatttaatctgatgccggaacatggaaatgaccataccttgaccggagtcagcgagttgtctttaaaagatttccttggcggaaactggaaaccattaattgatttaattgtagccggagaaatcaaaggaattgcaggtgtagtcggctgttccaatctgacagcaggcggacatgatgtgttatccgtagagctgaccaaagaacttatcgcaaaagatatccttgtcttaactgctggatgttcttcaggaggaattgaaaactgtggtcttatgacaccggaagccgcaaaacttgcaggtccgaaactgcgtgcagtctgtgaaaaattaaatattcctccggtattaaattttggtccatgtcttgcaatcggacgcctggaaattgtggcaacagaacttgcagaagcaatcggtgtagatattccacagcttccactggtgctttccgcagcacagtggttagaggaacaggcactggcagatggctgctttggactggcacttggacttccgcttcatcttggacttccaccatttgtaaccggaagcaaaaccgtaaccaaagtattaacggaagatatgaaggaactgaccggtggtcaggtgattatcaatgctgacgcaaaagaaagtgcggatattttagaaaaaatcatagaggaaagaagaagcgcattaaacatctgataaaggagggaacagaaaatgagacgaattatgattgactcagctaaatgcgatggctgtaaaagctgttctcttgcatgtatgcaagcacatcgagaaacaccgggaacaatctatgacttagatgtaacagactgcgcaaatgaatcccgaaattttatttataaaaatcagaaaggcggatatactccgcttttctgccgacactgtgataaaccggagtgtgttatgtcttgtatgagcggggcgcttaccaaagatgaaaagacaggtcatgtccagtatgatgagacaaaatgtggttcttgttttatgtgtgtaatgaactgtccatatggagtgttaaaaccggatgaaaagacaggaatgaaaattataaaatgcgacttctgtattggaaaaggagaagatccaagttgtgtaaaagcctgtccaaaagaagcaatctgggtagaggaggtgtagcagatgaagtatgtaattattggtgttggagcagcaggaattatggctgcaaagacaatacgaaaagcagataaagaatcttctcttactatgatttctctcgatacccaggttcactcaagatgtatgctgcataaatatctttctcatgaaagaaatgaaaaacagttaagttttattccggagaatttttttgaagaaaatcagattatctggaataaagcacagagcgtaaaacagcttcatgtaaaagaaaagcaggtcgaacttttagacggaacaaaagttgagtatgataaacttttaatcgcaacaggcgcaaacagttttattcctccggttggaaatttaagagaggcaaaaaatgtctttggtcttcgacatttaagtgatgcacaggcaattgaccaatctgccaaagaagcggagaatattgttattattggttcaggtctggttgggcttgacgcagcttatggtctgatggaaacaggaaagaatgtttcaattgttgaaatggcagaccggattcttccggtacagcttgataagacagcagcaaaagaatatcagaaacgttttgaatctgcaggagctaagttttatcttggaagaaaagcagcagaaacaaaaatggatgagaacggaaaaattacgacggttattttggacaatggagaagaattaaaatcggatttgattattgtggcagccggagtgagaagtgcaacagcaggttttgagacagaggaaatcatagtcgacagaggcatgaaagtagatgagtttatgcagacaggagcaaaagatgtctatgcagcgggagatgtaaccggactttccggaatctggccaaatgctcagaaacagggagaaaccgcagcacttaacatgatgggcggacgtgtcccttatacggatcgctttgccgctaaaaacacgattaatttctttggattaaattcactttgcgttggcgaaattgtaccaaaagagacagatgtggtgattacaagagaagatgcttctaactataaaagagttatcattcgagatggaaaagtagcaggagtactgcttcagggagatatttcccatgcaggaatctggcagtacctgattaaaaatcaaatttcggtagcgggtatcaaaaaagatatttttgcgctgaatttcagtgatttctatggaatcaaagaaaatggagaatatgtctggaatttttaaaaaggggttgacaaagtccgtattttctgggtatactttgtttgtcttaagacagaaatttcagatagaaaaaagcagtgagaggaacaagtagtcaccgaaggaatctacagaaagcagccggaagatgagaggcgcagaaaaacattggaagatgaatacatccttaagctttgcaccgaatggcagagttgcttagtaggctgtaacggagtggcactcgttattgtgctcaagtatcgcaaaaaagctgtacttatagaggcaggaaatgtgagttttctgtaaataaaggtggtaacacgaaagtgatagactctcgtcctttttagaaaggatgagagtttttttatatcaaaaaaaggagaaaaaacaatgaaaatctatgaagaattagttgccagaggtttaattgctcaggtaacagatgaagaagaaatcagagaactggtaaacaatggaaaggcaacattttacattggatttgacccgaccgcagacagtcttcatgttggacatttcatggcattgtgtctgatgaaacgtctgcagatggcaggaaacaaaccgattgccttaatcggaggcggtaccggtatggttggagatccatccggtcgtacggatatgcgtcagatgctgacagaagaaacgattcagcataactgtgattgttttaagaaacagatgagtcgttttattgacttctcagatgacaaagcaatgatggtaaataatgcagattggctgatgaaattgaattatgttgaagtattacgagaagttggttcttgtttttctgtcaataatatgctgcgtgcagaatgctacaaacagcgtatggagaaaggattaagctttctggaatttaactacatgattatgcagagttacgacttttacatgttataccagaaatacggatgtaacatgcagtttggcggaaatgaccagtggagcaatatgcttggcggtacggaactgattcgtcgtaaattaaataaaaatgcctatgcaatgaccattaatctgctcttaaactccgaaggaaagaaaatgggaaaaacgcagtccggagctgtatggcttgatccgaataagacttctccgtttgatttctatcagtactggagaaatgtaagtgatgctgatgtattaaaatgcctgcgtatgcttacattcctgccgttagaacagattgacgaaatggataaatgggaaggaagccagttaaatcaggcaaaagaaattttagcttatgaactgaccggacttgtacacggagaagaagaggcaaagaaagcgcaggaaggtgcaagggcattattctctaaaggaaatgcaacagatatgccgacaacagaaatcgaagaggcagatttgacagaaggagaagtggacttaattacgttgcttcagaagagtaatcttgcgtctacccgttctgacggcagacgtgccatcgaacagggtggggtttccattgatggtgaaaaagtaacggacatcaaatttatggttgtaaaggaaaacttggaaggcgacggtattgttatcaaaagaggtaagaagaaatttgcaaaagtaattttaaagtaagataaaagtaagatacaaaagcaactatatttgtctttttttcagaaagaagaaaggcaaaaatggttgctttttactgtatggtgtgatagtctgatatcacaaagtaaaaggcggattgaacaaaaaacattcgcagcaaatcaacagaaatctattcattttattcagttacaaaatcaaagatgaaatctcatcgattatccacaatatagaaattttatcaaaaaaaagatactgcttctatccgcctgaaacaggaggtcatctatgaaaaaaacaggaattatttttaatggacttaaagtacgtcaaaaacaaagacaaatatgtgaagagccagaaaaaaatgccatccgtgaagaaaatgcttatgaagtcaaagaaaaagaagtctgtcttgatgtgacttattttcttacgtttgcagtggtacataatccggtatgcaaaggtaagatgaaacaattttcagttcttcagattttacattatcaaaagttattcgaagcatccaaatatcatggagagtattttttatcctgtcttggatatgaagaatattattatgcccaggtcgtgcttggaatgttgtttgaaattcgagagggcgagaaaaaagaggcaaaaaagagttatgagagtttgattgagatgataacggcaggctggtgtgaggtcagagaggaactgtttgaaagaccaagtgtaaaatttcataaaattcaagaatgggcaggtctgtatacggaacagccggcaatgggcttaagtcagctttgtattgtatatctgttggcagaagtctttcaggtgaaaattcttcctgacacaaattctgccctgttgtttcaatgtatgttagatagaaatactatttggaacagtccaaaagcagaggttatggaatatccatttcaaaatgctaaagcagaacaaaaaagtatggaatttttacgaattttaagaaaacagatgaagtatccatatcgggcaattaccggatttttaaacaaaaaagaagaagagtttgattattacctgcagaatttgttccatttaggaggaattgaccggaatgtgatttgtggagagaaaattgataaacagacatttgagattttaacggaacttggaggatttgaaaatgagcagagtttaaaagaatatgtctattctctttatattgtgttgttaagtcaatatgtgtcaaaatgtctgaattatctaaaagttcagaatccggcagtatgggaaacaaaacgaatggaaatgcaggacagggaggaaattttactaaaaaagatagcggagctggaaaaaagaagttgacaaatgaaaaaatgaggactatacttataacaaatttaagtgaatagcactttaaaccgttgaacaagaggagtaaataaagaaatccgttaaagcagagagatctgttacagagagttgtagatggtggaattacagcaatgtgaatttttattgaatggacttgtgagggcagcttgaaatttgaaaaaaagtagacgctgacgggaaatcccaaccgttatcaatggggcgtgtatgatagtacatgggaagagtggttcaggaaaacctggataatttgggtggtaccgcaggagcgagaaataaaaaggctcttgtcccattagagaaaatctaatgggacaagagccttttttaattcataagaaatttcgtcttatgaattaaaaaaacgctccgcaagaatgtgccttggtacattctttgttcttggatagaaaacatattcagaaaggatggcagatatgaaaataacaccagattgcaatacaatattaaaattagcagaagaatattcggttgttccggtctgcaaagaaatttatgcagatatcacaacaccgattactttacttagaaaaatctctgcaatttcaaaaagatattatttgttagaaagtattgaaggtggcgaaacctggggaagatattcctttctcggatatgacccgattatgcgtgtgacctgccggtcaaatgaagtggtagttgagaaaaaaggaaaacaggaaacttatcaaaccgaaaaacctctggaaatcattcgtgagattatgaaagattaccgttcaccgaaattagagggaatgccgccatttacaggagggtttgtaggttattttgcttattcgatgattggatatgcagagccggttttaaaaattaaaaaaggaacctttccggattatgatgtaatgctgtttgataaagtcattgcttatgaccatttaaaacagaaaatctgtattatcgtaaatatgaaaacagatcgggtaatggaaaattatggagaggcaactgctgaaattgcgaaaattgcagctatgattaaaaatgcatcgattccggaatttccaaaggagatagaaaatattaattttacctgtaacgtcagcaaagaggaatattgcagtgttgtagaaaaaacaaaagagtacattaaagacggcgatattttccaggcagttatttccagacagtttacaagtccaatgaaaggaagcctgttaaatgcttaccgtgtattaagaacaaccaatccatctccttatatggtatatctgcactttgatgaggaagaattgatgagtagttctccggaaactctggttcgtctgcaaaatggaagattgacaacgtttcctgtagccggttcaagaccaagaggaaagaaccgagaagaagatgaagaacttgaaagagatttattatccgatgaaaaagagttatcggaacacaatatgttagtcgacttaggaagaaatgaccttggaagaatcagtaaattcggttcagttgacgtgacaaaatacatgatgattcacagatattccaagattatgcatatctgttcacaagtggaaagtgagattgaatcattgaaagacggattagatgcaattgaagcagtacttccggcaggaacactttccggtgccccgaagattcgtgcctgtgaaattattgaagagttagaaagcgaagaaagaggaatttacggtggggcacttggatatctcgattttgcaggaaatctggatacctgcattgcaattcgaatggcagtaaagaaagacgataaagtatatgtgcaggccggaggcggtattgtagcagacagcgttccggaaaaagaatatgaagaatctgcaaataaggcagcagccgtgatgcaggcaattcaaaatgcagaggaggtagacaaagtatgattcttttaatcgacaactatgacagttttacttataacctggttcaggtaatcggaacaattaatccggatatcaaagtcatccgaaatgatgcaatgagtgtagaagagattgaaaaattaaaaccttctcatattattttatctccaggaccgggatatccaaaagatgccggtgtatgtgaagaagtggtaagaaaattacagggaaaaatcccgattttaggggtctgcctgggacatcaggcaatctgtgaagtatatggtgcaaagattactcatgcaagaaagttgatgcatggaaagaagagtcgtgtaaaaatcgaaaccgaaagtccgatttttgcaggaatggaagaagagattgatgcagccagatatcattctctgattgcaaatgaagatacgattccaggctgtctgcaggtgctttcaacagatgaaaacggtgaaattatggcagtaggacataaagaatatccggtttatggattacaattccatccggaatctattttaaccccgaagggaaaaacgatactggaaaattttttgaatataaaggcaggtaaaggagacagacttatgattaaagaagcaattcatactttgatgaatggacaagatttgtcttatgatatggcaagagaagttatggaagagatgatggatggaaccgcaacacaggctcagatggggtctttcttaactgcacttcgcatgcgtggtgagacaattgatgaaattacggcatttgcgcaggtgatgagagaaaaaggtgtaaaaatcaagccggaaagagaagtcattgatattgtaggaaccggcggagatgaagttggaacatttaacatctcgactacttctgcttttgtggtagcagctggtggtgttccggtagcaaaacatggaaaccgtagtgtttcaagcaaaagtggtgcagctgatgtattggaaaatctgggtgcaaatgtggcattagatgcaaaacaaaatgaaactatcttaaatcagacaggaatgtgctttatgtttgcaccggtttatcattcttctatgaaatatgccgcaccggtacgaaaagagatgggagaaagaacagtatttaatattttaggcccactttccaatccggcagcggcaaccatgcagttgcttggggtttatgataaaaagctggtagaaccacttgcaaaagtgcttggaaatcttggagttacaagaggtgttgcagtttgcggttcagatggacttgatgaaattaccgtaactggagaaactactgtttgtgaaattcgttttggagaaacaaaaacctatacgatctcaccggaacagtttggaataaagcgttgtgaattatcagagctgataggtggaacaccggttgaaaatgcacagattacaagagaaatcttaaccggaaaagaaagaggagcaaaaagaaatgcagtgttgttaaatgccggaatgagcctttatctcggaattgatggaattacgcttgaagaaggtgtcaagatggcagccgatttaattgacagtaagaaagcacttgcgaaattagaagagtttgtgaaagtgacaaaggaagtataaggaggagcgccgatatgattttagaccaaatagcggcagataccaggcttcgtgtggaggcaaagaagaaagagatttctttagaagaagtaaaaagagacgcacagagcatggaaaaaaatacaggatttccgtttgagacagcgttgagaaaaccggacctgagttttatctgtgaagtaaaaaaagcgtctccgtcgaagggaatcattgccgaagaatttccttatcttcagatcgcaaaagagtataatgaagcaggagcggatgcaatttcctgcctgaccgaaccgaaatattttcttggaaaagatgaatatttaaaagagattgcaaaagaagtaaagataccggttttaagaaaagactttgtagtggatgaatatcaaatttatgaagcgaaaatattaggtgcaagtgctgtacttttgatttgtgcgattttagaagaagaacagttaaaagtttatcttcaaattgcaaaagagcttggtttatctgcgcttgtagaggcacatgatgaaaaggaaatcaagcaggcagttcgtgcaggcgcgaaaattatcggagtgaataaccgaaatttaaaggatttttctgtgaatgtaggaaacagcacaaacttaagaaattttgtaccaccggaaattttatttgtggcagaaagcggaatcaaaggaccagaagagattaaagctttaagagaaaataaagttgatgcggttttgattggtgaaaccatgatgcgcagtccggataaagcaaaaatgcttcgtttcttaaaaggggaagaacaccatgaagaaagttaagatttgtggtttaagaagaaaagaagatatcttaatagtaaatcgtttgaaaccagactatgttggatttgtatttgcagacagctccagaaaagtgacaaaagaagaggcaaaagcactttcaaagcagttagaaaaagaaatttgtccggtgggagtttttgtaaatgaagaaccggagatagtcgcccaaattgcgaatgccggaatcattgacttgattcagcttcacggagaggaagacgaggcatacatacaaaaattaaaagcatttaccaataaaccaataataaaagctgtgcgggtgagaagcagagaacagattcaaaaagcagaagctctttcctgtgattatcttctgtttgatacttatatcaaaggacagtatgggggaagtggaaaaccctttgatgtctcactcataggagaggtttcaaagccatattttatcgccggcggtttaagtgaaagcaatgtggcagaaaaattgaaaaactgtgatgcatttgcagcagatgtcagcagtgcagtggagatagatgggtataaagacgaaaaaaaggtacagcagtttatagaagcagtacggaaaggataaaaaaatgagtaaaggaagatatggaaattacggaggacagtatattccggaaacattgatgaatgcagttttagaattagaggaagcatatgaaaaatatagtaaagaccttgaatttaataaagaattagatgatttattaaaaaattatgcaggtcgcccatctttattatattatgcagaaaaaatgacaaaagatttaggcggtgcaaagatttatctaaaacgagaagatttaaatcataccggttctcataaaatcaacaatgtacttggacaggtactgcttgcaaaaaaaatgggaaaaactcgtgttattgcagaaaccggagcaggacagcatggggtggcaactgcaaccgcagcagcacttatgggaatggaatgtgaaatcttcatgggaaaagaagacacggacagacaggcattaaacgtatttcgtatggaactgttaggtgcaaaagtacatgcggtgacaagcggaacagcaactcttaaggatgcagtaaatgaaactatgcgtgaatggacaaagagaatggatgatactctttatgtgcttggttcggttatgggaccacatccatttccaatgattgtgcgtgatttccagaaaattatcggaaaagaaattaaagaacagttacgagaaaaagaaggcagacttccggatgcagtgattgcctgtgtcggtggcggaagcaatgcaatgggaacattctatgaatttattccggataaaggggtaaaattaatcggatgtgaggcagcaggacatggaatcaataccgataaacatgcagcgactattgcaaaaggaagcgaaggagtatttcatggaatgaaatccttgttttgtcaggataaatatggacaaattgcaccggtatattcgatttcagcaggactggattatccgggaatcggaccggagcatgcaaatttaaatgcaaccggacgagctcagtatgttccgattacagatgatgaggcagtagatgcttttgaatatctttcaaaaacagaggggatcattccggcaatcgaaagtgctcatgctgttgcttatgcaagaaaactggcaccgacgatgggaaaagaccagattattgtagtgaccgtatccggtcgtggagataaagacgttgcagcaattgcaagatatagaggagtggaaatctatgagtaaaatagcaaaagcatttgagaacaaaaaagcatttattccgtttgtaacggcgggagacccgacacttgatgtgacagaacagttattatatgaaatgcagaaagcaggagcagacttaattgaaatcggaattccgttttcagacccgacagcagaaggaccagtcattcaggaggcaaatgaaagagcgcttgctgaaggatgcacaacggataaaatttttgatatgttgaaacgtgcaaaagaaaaaattacggttccaatggtatttttaacttatgttaatccgattttcacttatggaaaagaacgttttatgaaacaatgcgtggaaagtggaattgatggtctgattgtgccggatatgccttatgaagaaagggaagaacttgcaccggcatgtgaaaaatacggagtggacattattccgctgattgcaccgacttctcatgaaagaattaaaatgatagcaaaaaaagcacagggatacatttactgtgtttcgtctttaggtgtaaccggtgtcagaagtgaaattaagacagatattggggcaatggtaaaagcagtaagagagacaacagatgttccgtgcgcagtcggatttggaattgcgactccagaacaggcttacaagatggcaaaagtttcggatggagcaattgtgggttctgcaatcgttaaaattatagcaaaatatggaaaagacagcgttccttacgtaggagattatgttaaaagcatgaaagaagctgtagaaaaagcggataaagaaagtaaataatccagaaaataagtttaaaacagccgattctactaaaaaagagccggctgttttttcagcttgcagattaataagaaattcacaattttttagttgaaaaaaattgaaaaacaggttacaattaaaatcggcagaaattggttttgttcttcaactcattagagcgaaaaaccaaaatgtggtttctgcgcgaacaggattcactgtcaaataggtgcagaaatccgcaaataaaaatatatggagggctgatcaatgagtaatacagcacaaagcttggcaggcaaaagaattgaagctttgcttgatgagaacagttttgttgagattggcagttgtgtaacagctagaagcactgatttcaacttatctgaaaaggaaacaccatctgatggtgttattaccggttatggcgtaattgacggaagcctggtgtatgtatacagccaggatgcatccgtattaaacggaacaatcggtgagatgcatgcaaaaaaaatcgtaagactctacgaactggctatgaagacaggtgctccggttatcggtcttgtagactgtgcaggtttcagacttcaggaagcaacagatgcattaaatgcatttggtgaaatctatgcaaaacaggttgcagcttccggtgtcattcctcagattacaggaatctttggaacatgtggtggcggacttgcggttatgccaggtcttacagactttacatttatggaagagaagaaagcaaaattatttgtaaactctccaaatgcattagatggaaatgaaatttccaaatgcgatacatcaagtgccaaatatcagagcgaagaaagcggacttgcagatgtaacaggaagcgaagatgaaatcattgcaaaaatgagagaattagtttccctgcttccatcaaactacgaagataattctgcttatgtagagtgcacagatgatttaaatcgtgtatgccctgaacttgtaaactgcgcaggtgatacttctatcgcactttctcttcttgcagacaaccaggaattctttgaggtaaaagcagattatgcaaaagatatggttgttggatttatccgtttaaacggagcaactgtaggatgtgttgcaaatcgcagtgaagtttacaatgcagaaggagaaaaagcagagacatttgataatgtattatcagtaagaggatgcaaaaaagcagctgatttcgtgaaattctgtgacgcttttgaacttccggtactgactctgacaaatgtaaaaggctataaagcgacaaaatgttccgaagcgaatattgcaaaagcagcagcatctttaacttatgcatttgcaaacgcaactgtaccgaaagtaaatgttgtagttggagaagcatttggaagtgcttacctgacgatgaacagcaaatcaacaggagcagacatggtatttgcttggccggaatctcagattggtatgatggatgcaaagctcgctgcaaaaattatgtacgcagacagtgatgcagcaacaatcaatgaaaaagctgcagaatacgcacagcttcagtcaagtgcactttctgctgcaaagagaggctatgttgatacaatcatcgagccggaagatacaagaaaatatgtgattggtgcttttgaaatgttattcacaaaaagagaaaatcgtccaagtaaaaaacacggcacggtttaagcgaggtgaattaatatgaagcagacatggaaaaaaatcattggactgattctgattagcgtatgtatcttggcaatgaccgcttgtggaaagaacagtagtgaagaaacaagctctcttacgatgccggatgaagcatctcagcagtccttaatcgagagttttggaactgtactccagaatatttctcagttggatgaagcaagcattaaaagctatatggaaggcgatgatgcatttagtgcagcggcagcttctgcttgggataccagcggttcttctttaggaagttttgaagaagttaaagatggtaaaatggaaatcgacgatgacacttatgtagttactattgatgcaaagtttgaaaatcgtgatgcagattgtgtgtttatacttgataaaaatggaactcctaccagtgtcagcattgaccctgtttacagcatgggtgaaaaaatggcacaggcaggtcagaataccgttatgggtatcggaatcgtatttatcatgcttatcttcttaagtttcctgatttctcttatgagatttatcccgaaactggaagcagctttatcaaagaaaaacaaagcaccagaacaggcaaaaccggcaccggttgttgctgttccggaagtagaagaggaagaagtaattgatgatggcgaactgattgcagttatcgcagcagcaattgcggcatctgagaatacatcgacggacagctttgttgttcgttcaatcagaaagtcaaaaaaaggaaattggcacagagcctaatcacaggaggaaatgattatgaaatcttatacaatcacagtaaatggcgttgcttatgatgtaacagtagaagaaggcgctggaaacgctgtagcagcatctgctccgaaagcagcaccaaaggcagcaccaaaagcagcacctgcaaaagcagcagctccggcatccgctggttctgtaacagttgcagcatctgcagcaggtaaaatcgtaaaaatcgaagcaagcgtaggtcaggcagtaaaagctggagacagtattgtagttctggaagctatgaaaatggaaattccggttgttgctccacaggacggaaccattgcaagtattgacgtagcagttggtgatgcagttgaaaacggtagtacactggcaactatgaactaaaaatttgcaaatagagtgatttatttgtaagtttgcggtcgtagatagaaatctgcgaaaaatacagacaatgggaggtaataaaatgtctagcataacagatacattgtccaatctgcttggtcagacagcgtttttgaatctgacatggggaaactatctgatgattctggttgcttttgttttcttatatctggcaatcagacatggatttgaaccgctgcttttagtaccaatcgcatttggtatgctgttagttaatatctatccggatattatgtcacagccatatacggatgcagccggtattgaacatgcaggtggacttcttcactatttctatttgatggatgaatggagtattcttccgtcactgattttcatgggtgtaggtgccatgacagactttggtccgctgattgcgaatccgaagagtttccttttgggagcagcagcacagcttggtatctatatggcgtatttccttgcaatctttatgggattcaatggaaaagcagcagcagcaatctctatcatcggtggtgccgatggcccgacttctatcttccttgcaggtaagcttggacagacagcattaatgggaccgattgcggtggcggcgtattcttatatgtcactggttccaattatccagcctccaattatgaagttattcacaacagaaaaagaacgtaaaattaaaatggaacagcttcgtccggtatccaaactggaaaaaatcctgttcccggttatcattacagttgttgtttgtctgattttaccatctacagctccgttaattggtatgcttatgcttggtaaccttttccgtgaatgtggcgttgtaaaacagttaacagaaacagcatctaatgctttaatgtacatcgtagttatccttctcggaacatccgtaggtgcatctacaagtgcagaagcgttcctgaaactggatactttaaaaattgttgctttaggtctggtagcatttgcagttggtacagccggtggtgttcttcttggtaaagttatgtgtaaactgacacatggaaagattaatccgctgattggttctgctggtgtatccgcagttcctatggcagcccgtgtatctcagaaagttggtgcagaagcagacccgactaacttcctgctgatgcatgcaatgggaccaaacgttgccggtgttatcggtacagccgtagctgctggtacattcatggcaatctttggtgtataattgaaggaggaaaattaagatggcagatgtggtaaaaaaaccaattaaaattacagaaacaattctgcgtgatgcgcatcagtctctgattgcaacaagaatgacaacagagcagatgctgccaatcgtagataaaatggataaagtcggttatcattccgtagaatgctggggtggtgcaacatttgatgcatctcttcgtttcttaaaagaagacccatgggaaagacttcgtaaattccgtgatggttttaaaaatacaaaactgcagatgttattccgtggacagaatatccttggataccgtccttacgcagatgatgtagtagaatacttcgtacagaaatcaattgcaaacggtattgatattatccgtatttttgactgtatgaacgatatcagaaacttaaaaacagcagtttctgcagcaaacaaagaaaaaggtcatgcacaggttgcgctgtcttatactttaggtgatgcttatactttagaatactggacagaaatggctaaaaaaattgaagatatgggtgcaaattctatctgtattaaagatatggctggtcttctgcttccttataaagcaactgaactggtaactgctttaaaagaaacagtagatattccgattcagcttcatacacactatacttccggtgttgcttctatgacttacttaaaagcagtagaggcaggtgtggatgtgattgatacagcaatgtctccattcgctctgggtacttcccagccggcaactgaagttatggtagaaacatttaagggaactccttatgatacaggatttgaccagaaactgttatctgaaatcgctgattacttccgtccaatccgtgacgaagcacttgacagcggactgctcaatccgaagaaccttggtgttaacattaagactctgttatatcaggtaccgggcggtatgctttctaacctgacttctcagttaaaagaacagggtgcagaagataaattctacgatgtattggaagaagttccaagagtacgtaaagaccttggtgaatgcccgcttgttactccttcttctcagattgttggtacacaggctgtattcaatgttgttctgggtgaacgttacaagatggttacaaaagaaacaaaagatgtattaagcggaaaatacggtgcaactgcaaaaccgttcaacaaagaagtacagaaaaaatgcatcggtaatacaaaaccgattacctgtcgtccggctgacttaattccggctgagttagacactcttagaggagaaatggcacagtggtctgagcaggaagaagatgtattaacttacgcattattcccacaggtcgcaacagaattctttaaatacagagaagctcaggaaacaaaagtagatccgaaaatggcagacacaaaaaatggagcttatccggtataaataagattaaattttccgaaggcgaatcgtatggaaatacggttcgtctttttgttttaggcataaaatcattttgtgtttagtaaaattcagatgaaaaataattaagttcgtgttataatataaacttaatgaaagcattactatagaatgttttaagacaggaaaagaggttaaggggtaaagtatggggacggaagagaacttacttagcaggatgaatacacagtatcataaatttagcaaaggtcagaaaaaattagtatcgtatattacggacaattatgataaggctgctttttttacggctgcaaagttaggagaaacggttggagtaagtgagtcaacagtcgttcgtttcgcaattcatttaggatataaaggatatccggagtttcaaaaggcactggaagagttggtgaggaacaagttaaattcaattcagagaatggaagtgacttatggaagagttccacagtctgaaattttagatacggtacttcgagccgatattgaaaaaatcaagctgacaatggaaaatatagaccataatgcgtttgaacttgcagtggagaccattcttgaggcaaagagtatttatattgtaggaatccgcagttgtgcaccactggcaagctttttgggattttattttaatttattatttgataatgtacatttgatgcatacaaacagttcaagtgaattatttgaacagatgattcacatcagcaaggacgatgtgattattggaattagttttccaaggtattcgatgcgtacattaaaagcgcttgagtttgcaaataatagaaatgcaaaagtaattacattgacagacagcattcattcaccaatgaacttatattcttcttgtaacttgattgcgagaagtgatatggcgtcaattgtagattcacttgttgcacctttgagtgtgattaatgcgttagtagtcgcactttgtatgcgcaaacaaaaagaggtgactgctacgttagaagatttggaaaaaatttgggatgaatatcaggtgtataataatgatgaaattaatcttgcggatgggaaagaaattgaaattcgtaatccggatgagttagaagattaaaaggagtgtttcatgacaaaaatagcaatcatcggtggcggtgctgccggaatgtatgcttctgtttttcttgccgaaaagggacacgaagtacatgtatttgaaaaaaatgaaaaacttggaaaaaaattatttattacgggaaagggtcggtgcaatgtaaccaatgactgtgatgaagagacatttttttccagtgtgattaccaattcaaaatttttgtatagttcttattatggatgcacaagtcaaaatgtaatggatttctttacctcaattggggtaaaactaaagacagaacgtggaaaccgggtatttccggcttcagaccattcttcagatattattcgggcattagaacataaaatgagagaaacaaaggttcagattcatctaagaacagaggtaaccgatattttatctgaagaggactgtatcaaatatgttgtgactgcaaagggaaaagaagcctttgataaagtaatcgttgcaacgggcggatattcttatcaggcaacgggttcgacaggagatggatatcgttttgcagaaaataccggacatagtgtgacaaaaatccgaccggcattagttccactaaaggtaaaggaagattatatcacaaaacttcagggactggctttaaaaaatgtacagctgaccatcaaagaccagaaaaagaaattgtatgaagagtttggagagttgttgtttactcattttggagtgtcgggtccgcttgttttgacagcaagttcaaagattggaaaacagcttgaaaaaaaaggcagtcttttagctgaaattgatttaaagccggcagtttcaaaagaacagctcgatgcaagaattttaagagagtttgaaacagttaagaataagcagtttaaaaacgcaattggaggtctgtttccggcaaaattagaaccggttatgatagaaatttctaagatttcgccggaaaaaaaggtcaatgaaattacaaaagaagaaagaagaagatttattgatttaatcaaagcatttccatttacgattacaggaatgcgtgactttaatgaggcaattatcacacagggcggagtaaagacaaaagaaataaatccgtctacaatggagtcaaaaaaggtaaaaaatttatattttattggagaagtgcttgatttggatgcagtaacaggtggatttaatcttcagattgcctgggcgactgcttactgcgcagtaaacgcaatttgtatggaagaataaaaaacaagaattggatgagataaagttaagatagataaaggagagaaaaaatggcatttagtattgcaatagatggaccggcaggggccggaaaaagtacaatcgcaaaggaactggcaaaacgcctttcatttgtttatgtagatactggtgcgatgtaccgtgcaatcggattgtatctgcttagaaatcagatttcaccaaaagatgaaagttctgtggaaaaagcatgtaaagaaattcagatatccatttcttatgaggatggggttcagcaggtctttttaaacggagaaaatgtaagcgaagaaattcgaaaagaagaagtaggaaatatggcttcggcaggtgcaaagaaccggaaagtccgcgaaaaactggtagagcttcaaagagaactggcttctaaggctgatgttgtaatggacggaagagatattggaacctgtgttttgccaaatgcgaatgtaaagatttatctgactgccagtgtgcatacaagagcagtgcgtcgttatcaggaatatcttgcaaaaggtgagaaaataacattagaagaagtggaaaaggacattgaaaacagagattatcaggatatgaatcgtgcgatttctccgcttaaacaggcagaggatgcagtatttttggattcttctgatatgggaatcgaggaagtattagagacaatgatttccgtttatgaaaaaagtaaataaaaaagaggtttaaaaagtggaagtaaaagtagcaaagacggcgggtttttgttttggcgtcaagcgggcagtagaaaaagcttatgaggttgctgaaaaagaacaaaaagatgtttatacttacggaccaattattcataatgaagaggtagtaaatgatttagcccaaaaaggagtccatgtcattgaaacagaagaggatttaaaaaagctgcaaaatggtattgtagttatccgttcccacggagttccaaaaagaatatattccctgcttgaagaaaaagaaattgagtatgtggatgttacctgcccgtttgtcttaaagatacaccggattgtggaaagagaaagtaaagccggacggcatattgtaattattggaaatgaggcacatcctgaagtagagggaattcgtggctggtgtgaaggagaatctactgtgataaaaacaaaagagcaggcagaaaaatttctggaatcaccacccgaaaaggtgtgtatcgtctctcagacgacatttaattacaagaattttcaagaattagttgaaattttagccaaaaagaggtatgataaacttgttttaaatacaatttgcaatgcaactagtgagcgacaggccgaagctgcagaaattgcaaagacagtagacgccatggttgtcattggaggcaggcatagctcaaacacacaaaagctgtatgagatatgcagtggcgaatgtaaaaacacctactatatacagacacttgctgacttggattctgatagttttcaatccattcaatgtgttggtattacagccggggcgtcaaccccaaataaaataattgaggaggtttcaaaacatgtcagaattaagttttgaacagatgttagacgaatcatttaaaacaatcagaaacggagaggtagtggaaggtactgtcatcggcgtaaaagaagatgaaatcatcttaaatatcggatacaaagcagatggtattatttcaagaaatgaatattcaaacgattccaatcttgaccttactacagttgtatctgtaggcgacacaatggaagcaaaagtcctcaaagtaaatgatggagaaggacaggttcttcttacttacaagagactggctgctgaaaaaggaaataagagactggaagaagcttttgaaaataaagaagtattaacagcaaaagtaactcaggtattagatggcggtttaagcgtactggtagaagatacaagagtatttattccggcaagcctcgtatctgattcttatgaaaaagatttaacaaaatatcaggaccaggaaattgaatttgtaatcacagaatttaatccaagacgtcgtcgtattattggtgaccgtaaacagcttttagttgctaaaaaagcagaaatgcagaaagaactgtttgcaagaatcaaaccgggcgatgttgtagaaggaacaatcaaaaatgtaacagactttggtgcattcatcgatttaggtggagcagatggtcttcttcatatttctgaaatgtcctggggcagagtagaaaatccgaagaaagtattcaaagccggagatccaatcaaagtattaatcaaagatatcaacggagataaaattgctctcagccttaaatttgaagaccagaatccttggttacatgcagctgaaaaatatgcagctggtaatgtagtagaaggaaaaattgcacgtatgacagattttggtgcatttatcgagttagaaccgggtgtagatgcattgcttcatgtatctcagatttccagagcacatgttgaaaaaccatctgatgtactttctgtaggacaggttgtaactgcaaaagttgtagacttcaacggagaagaaaagaaaatcagcctgagcatgaaagtattagaaccggcagcagaagagacagcagaaacaacagaagaataataaaataataaaaatgtaacaacgagaaaaaaacggctgcttagaggcagtcgttttttatttttctatttctttggaagattttttaaaaattctcttaaaaattcctgctgcatttcgggtgaagtagaaaattctgaagtccactgaatataaatttctttactctcataatcggtcttaaattgagaaagatttggattaccataagcacgcagaaaaaatccggaaatctttttatagcagttggaagcttttgccttttgacggcaggacgaatcgacataagaagcaatggatttatgaaccgcttcatcctcaagaggaagataataataatttttataatttttgtagaagtatcttaatgttccagataaaagaggcagttttaattttcccgtatgcccggagaaagtgagagagaacatttctaagtgataagaaaaatcagtcggaagaacagatggcagtgaaaattgaaataaaatatctgtgcggatatcgccatttaaagttgtgctttttaaaatatgactttgaatgaattcaaatttaccatttaggacagcttttaaaatatcaagagagagcagatggaacattccttctatatcatcatggttatgaaggagaagcaggttttgatcctcttttttatgcagagaagcaaaggaatgaaagacctgaattaattgttttccgtccatggtatcaagtctttgataatggcagagaggttccagtgttctctgtttaaaatcagaaaccggaagtaaaaatgaaattggacgcagagtccgatataaatcgatagatttcattgaaagaagaggggatgaaacctgatattgtgtggacttatgaagtaaatatgggatatcaaaagtagttccattaaaatgaatcagacagtcacggtctgagcaaagcttataaaaggactgtaaaagtgctgtctcttcttcggaagtttcatgttcagccagaaattgataaagtttgaacgaagttttttcaaagactgcagctccaattaggtaaagatgactggttttatggcttaatccagtcgtttcaatatcgaaaaatagagttcgttcttttgaaatggaatttttttggaaaaaatgatctatgcaattataataaaaatttgaataaaaactagctattgttaacatattaacaaacatcctttcgatatgtactaaaaataatacgaaaaatttactaaattttatagagaaattacaaaaaaaatgttatattattataagagagcaaaaaggaggtaatatggaagttaaaattgcgggagtctctttgtattatatcataaactggttttttatctacagctttctgggatgggtgtgggaatcctgttacgtgtccgcaaaagcaaaaaagataataaacagaggttttataaatggtccattgtgtaccatttatgggttcggagcaatcagtgtatatttaatcttgaaagattttgacgaaaatatactgattttgtatttcggtggagtgattgttgcaacggtgttagagtacataacaggctggctgatggaagcgatttttcatacccgatggtgggattacagtaaaaagccatttaatcttcagggatatatctgtctggggtcatccattgcctggggtgcatttacggtgttactgttttatgtatttcagccgtttgtggaatggattacaggactttatcctgtgtctgtgggaaaagttggaatttccattgtaagtgtgttatatgcagttgactttggaagttctgcagtaacagcgttcaatttaagcaaagcctttggaaaagtggaagatatgctggaggatttaagtggttatcttcatacaaccaaattatatgagacaaaagaggaagttcgtgagaaactggatgaattacgtgtgataaatgcatcagaactggcagagcgcattgcagagaagaaagcagaattttcatcacagcttgagaaaaaacagctgcaattgccggaaacttatgaaggaatgcgtgcagaactggaaaaacgcatggatgaatttaaagaaaaatatatcacgattcgtaaagagaccaatcctgttagaaaacgtatgatacaggcgtatcccggattgaagactgaattcagacatcatttagaaagaaagtctggaaaaagacatgaaaaacgaatttcaaagtaaaggaggaactatatatggcgtttttaacctttaggggtggagtacatccttatgacggaaaagaactgtcaaaagaaaaacccataacggactatgctccgggaaaagagctggtttatccattatcccagcacattggtgctccggcaaaaccggtcgttaagaaaggagaccatgttttggcggggcagatgattgcggaggcgggcggatttgtatctgcaccgattcatgcatctgtttcaggaacagtgactggaattaaaaaaattctcaataatatgggaagcaaagtagatgcgattattattgaaaatgatgagcaatatgaaagtgtaccggatcaggtgacggagtctcttgattcactttcaaaagaagaagttttaaataaaatccgcgagggcggagtagttggtatgggtggagcaggttttccgactcatgtaaagctttctccaaaagagccggataaaattgaatatgtactggtaaatggagccgaatgtgaaccatatctgacttctgattaccgtcgtatgatggattatccagatgaattaatcggtggattgaaatgcatgttgaaattatttgataatgcaaaaggctgtatctgtatcgaggataataagccggattgtattgcaaagatgacagagttagtaaaagatgaaccgagaattgaagtaaaaacattaaaaacaaaatacccgcagggtgcagagcgttgtctgatttatgcagtgacagacagagagattaactcttctatgcttccggcagacgcaggatgtgtggtagataatgtcgatacggtatgtgctgtttatcgtgcagttatgtttggacgtccggttactgaaaaaatcgtaacagtaaccggtgatggaatcgcaaatccgcagaatttccgtgtaaaaatcggaaccagttttgcggatctgattgaagcggcaggcggattaaacgagccggtagaaaaggttatctctggtggtccgatgatgggatttgccatgtatgactaccatgttccgattgtaaaaacttcttctgctattttatgtttaaagaaagatgaagtaacagcagtagaagcaacagcgtgcattaactgtggtcgttgtgtcagtgcgtgtccggcaagactggtaccgtcaagactggcgacttattcagaacatggacaggaagaacagtttgtaaaacataatggactggaatgtgtagaatgtggatgttgtagttttgtctgtccggcaaaacgtcatctgactcagtctgtacgttctatgagaaagatggttcttgcaaaccgtaaaaaggcaaaataggaggagaaaaagatgagtgattttctgcatgtatcatcttcgcctcatgtaaggtcgaaggtgagcacggacggcataatgaaaacagtattacttgcattgctgcctaccacattatttggaatttataattttggtttgcatgcactgcttttaattctggtttgtatggcgacctgcgtggcaacagaagccgtttatgaaaaaattgtaaataaaaaaagtacaataaaggattgcagtgcactggtaaccggtttgttgctggctctgaatcttccaccaaaagctccgtggtggattgctgttgtaggtggtatttttgctatcttaattgtaaaacagctctttggaggtctgggacagaactttatgaacccggcgcttgcagcaagatgttttctgttaatttcctttaccggaagaatgacagattttacggtaccggatggcgcatttggaaaagtggtagatacggtatctggtgcaactccactggcagcggtaaaagccggtgaaagtgtaaatctgatgagcctgtttatcggtaatacaaaaggtacaatcggtgagacatccgcactcgcaattttaattggtgcagcaatcctgcttgcaacaaaagtaattgatttgcgtgttccgcttacttacattggaacatttgcagtttttgcactgttatttggcggacatggatttagcatcagctatcttgcagcagagctgtttggtggtggcttgatgttaggtgcatggtttatggcaacagattatgttaccaccccaattacgaaaaacggacagctggtttatggtgtgtgtctgggtatctttaccggaattttccgtatttttggcggttcagcagaaggagtttcttatgcgattatcttctgtaacctgttagtaccgttgattgaaagagtaactatgccggttgcttttggaaaaggaggtaagaaatcatgaaaaaagattcgattgtaagagatacgttgattcttaccgtaatcacattgattgcaggtctgcttcttggactggtttaccagattacaaaagagccgattgcacagcaggaagaaagtgcaaaaacagaagcatataaagccgtttttgcagaagcagattcctttgagccaattgtggaagcagaagatgctgacctttccgcttatctggaacagaatggtttttcccagagtattaatgagatcatggaagcaaaagatgcgagtggagaagtgttaggttatgcaattaatattacgactccggaaggatatggcggagatatcactttttcactgggtgttaaaaatgatggaacgttaaatggaattgaaattttaagcatcagtgaaactgccggtcttggtatgaatgcaacaaaagatgactttaaaaaccagtttaaagacaaaaaagcggaagaatttaaagtgacaaagaccggtgcacagtccgaagatgaaattgatgcattaagtggtgcgaccattacttcaagagcaatggttggaggcgtaaacgcaggtctttgcgcatttcgatatgtagaggagggagaataggatgaaacagaatacacctgttgagcgtttgtataacggtatcataaaggaaaatcctacctttgtcctggtacttggtatgtgtccgacacttgcggttacaacagcagctatcaatggtatcggcatgggacttacaactacggtagtacttatgatgtcgaacttatttatatcacttcttagaaatgtaattccggataaggtacgtatgccggcttatattgttattgttgcatcttttgttacaatggttcagcttttacttcagggttttattccatctttgtatgatgcacttggaatttacattcctctgattgtagtaaactgtattatcttaggaagggcagaagcttatgcttctaaaaatcctccgattccatctttatttgatggtatgggaatgggacttggatttaccttatccattacaattcttgcagcgttccgtgaattaatcggagctggaaccgtatttggagttcaggtaatgccgaaggcttacgaaccggcaaccatttttattttagcaccgggagcattctttgtgcttgcatttttggcagcgattcgtgcaaaattacaggataagaaacccgaaggagaaagacacgaaatccattgcatggaaggtgcttgtgcttcctgtggtaataaatcctgtcataaacagtaaaggaggaaaggcgcaatgaaagaattacttattatcggaatcagcgcagcgattgtaaataatgtcgtgctgagtcagttccttggactgtgccctttcttcggcgtatccaagaaaatagaaacagcagcaggtatgggcggagcagttatcttcgttattaccttatcatcttttgtgacaagtttgatttataaatacatactggcaaatccgcatgttaatatgcagtttttacagactatcgtatttattcttgtaattgcagctttagtacagtttgtagaaatgtttcttaagaaatctatgccggcactctatcagagtctgggtgtatatcttccattaattacaacaaactgtgcggtacttggtgttgcagttatcaacgtacagaaagagtataatgtacttcagggaacggtaaatggttttgcaactgctcttggttttacaatttcaattgtactgatggcaggacttcgagaaaaaatggaatacaacgatgtaccaaaatatttccagggattcccgattgtattattgacagccggtttaatggccattgcattctttggcttttctggcgtaatctaaggaggcacggagtatgattacaggtattgtaattgcagcagttttagtaggtggcgtgggcctctttatcggagtgttccttggactggccggaaagaaatttgctgtagaagtagatgaaaaagaagttgcggtaagagaacagcttcctggaaataactgtggcggatgtggttacccaggatgtgatggtcttgcagcggcaattgcaaaaggagaagctccggtcaatgcatgtccggtcggcggagcaccggttgcagcgaaaatagcggctgtaatgggagaagaagtaggagaaaccgttcgtacaagtgcgtttgtaaaatgtcttggagattgtgaaaaaacgacttctctttatgaatatgcaggtgaagaagattgtaaaatggcagctttgatgcagagcggtggtaaaaaatcctgtggatttggctgtcttggttatggaaactgtgtgaaagtgtgtccgtttgatgcaattcatatcataaatgggattgcaaaagtggatcaggaaaaatgtaaatcctgcggaaaatgtgttgcagagtgtccgaaacatctgattgaaatcatcccttatggacagcatcaggttggatgcagttccaaggaaaaaggaaaagaggtcatgggagcctgtaaagtgggctgtatcggatgtaagaaatgtgaaaaagaatgtccggcaggagcaatcacagttacagataatgtagctcatattgataaagaaaaatgtacgaattgcggtaaatgcaaagaagtatgtcctagaaaagtaattgcataaaatgagtccaaagagccaaaatgcgaacatatatttgcattttggctctctttatgttagaatggaaaaatgaaaataaataaaaaagatatgatattaattggaggagtattactgctcgctttgattttctggttgattccttttataaatcagaagagagattctcttcaaaaagaagaacagcaggggatgctcaaaattacggtggatggaaaacagtatggtacatattcactttcaaaaaaccggacaatagaaatcaatgatacaaatatctgcgaaataaaggatggaaaggtgacaatgacagaagcagactgtccggacaagttatgtattcatcaaaaagcgatttctacaaagggaggaacaatagtgtgtttgccaaacaaagtggtattggaaatcgagagcagtgaaaaaccagatagtattacttattaagaaaaataagatattggatttagagagaatgaatgagataataataaaaaagacagcatatttaggcatattttctgcaattgcaattatatttggctatgtagaatctttatttcctcttggaatccctggagtgaaactggggcttgcaaatcttgtaattgtttttttgctttatttatatggggtaaaagaagctgttgcggtttcctttgtgcgtattctggtcattggttttttgtttggaaatctgttttctatattatttagccttgcaggcgcagtggtgagtcttggacttatggtgattttaaaaaagacaaaatggttctctgtagttggagtcagtgttgccggaggtgtctcacataatattgctcagattattgtagcgtcttttgttgtaggaaatttaaatctgttttggtatcttccggtattattggtatctggtgttatagcaggatttttgatgggaacgttagcaacggaagtattaaatagaatacagcttaaaaaggacagaacgggaaaggacagaatatgattgcttatataaaaggtgaagttgcctggatagaagaagaacgaatcgttttagagtctgggaatattggatataatattatgatgccggcatcttcttttgatacacaagatttagtgggaaaagaagttaagatttatacgcatttgaatgtaagggaagatgcaatgcagttgtatggatttttgaatttagatgaattaaaaacttttcgtctgctgttaggagtcaatggaatcggtccgaaagcagcacttgggattttatcgggtcttacgacagatgaacttcgttttgctgtgctttcagatgatgtaaaaacgatttcaaaagcacctggaattggaaagaagacggcacagaaattaattttagaattaaaagataaaattgatttggaagaggtatttgagacaaaacaggagcatgccagagaaacagaaggaaagatggaaagtaaagaagagaatgctgcaaaaaaagatgcagtcgatgcattgacagcgcttggatattcgagtacagaagcactgcgtgcagtccgtcagaccggggtgacaccggatatggatgtggaaacaattttgaaattagcgttaaaaaatatgaatttgtagtgggaaaagaagatggaaagaagaatcataacaacagatgtgatagaagaggacttaaagacagagggaaatcttcgaccacagctcttagtcgattatattggtcaggaaaaagcaaaagaaaatctgaaagtttatatcgaggctgcaaaacagagaaatgatgcattggaccatgttcttttttatggtcctccaggacttggaaagacaacgcttgccgggattattgcaaatgaaatgggagttcatttaaaagtaacaagtggtccggcgattgaaaaaccaggagaaatggcagcaattttgaataatcttcaggaacatgatgtattgtttgtcgatgaaattcaccggttaaaccggcaggtagaagaagtcttatatcctgctatggaagattatgccattgatattatgattggaaagggaacttctgcaaggtcgattcgtctggaacttccaaaatttacgctggtgggagcaacaacccgtgccggaatgttgactgcaccgcttcgtgaccgttttggagtggtacatcatcttgaatactatacagaaaatgaattaaaaacaattattatccgttctgcaaaagtgcttggagtagagattgatgaagaaggtgctatggagatggcaagacgatcaagaggaactccacgtttggcaaatcggctgctaaagagagtgagagattttgcacaggtgcgttatgatggaaaaatcacaaaagaagttgcggattttgcattgaatttattagaagtagaccgatatggattagaccagattgaccgtagaattttaagtacgattatggtacagttttcaggaggaccggtcggacttgatacacttgcagcggcaatcggagaagattccggaacaattgaggatgtatatgaaccatatctgattaaaaatggttttcttgtgcgaacaccgagaggtcgtgtagcaggcgattttgcttatgaacatttggggattgacagaaaatcttaaataagagccaaaagaaaaggttgtttttctctgtatttcgattataatagacagtgaaagaataagcaaaagaaaaatcgggaggaccctatatggcagtgaaaaatacaacgcaggttttgatcggaggtaagataatgaccttaagtggttatgaaagcgaagaatacctgcagaaggttgcatattacataaataataaaatgaccgagctgggtcagcttccaggttacagccgtcagtctcttgaaaccaaacatacgctgttggatttaaatgttgcagatgattattttaaggcaaaacgtcaggcagaattgtttgaagaagaactggaaacaaaagacagagaaagctatgaattaaaacatgatttgattacgtctcaggttcggctggaaaatgcagaaaaagaaattgcattaaaaatggaacaaatggaaaaattacaaaagaagatagaagagttggaaaaggaacttggcgggcgtcttaaaaaataagcagctgcaaaagattccgaaattgagagggcgcgcttcgaaagagggacacgccctttttctgtcataaaatctatagtggaaagttgatttgagtcagttaagcggatgtttggcttgtaattcatttttgggcttgatttggttaaatgattaaaagttgaatgacaggaaagaatcggaaaataagaaaggaatgaaaatttttatgaaattagagttactggcacctgccggttcgatagaaggaatgagagctgcaatagcagccggagcggatgccgtttatatgggaggagagttatttggggcaagagcttacgcaaataatcccgaggaggaaggattaaaagaagccattgattatgtgcatctccacaaaaagaaactgtatctgaccgtaaatacgttgttaaaaaataaagaattaaaaacacagctttatgattatattgcacctttttatgaacagggattggatgcagtgattgttcaggattttggggtacttacttttttaaaaaaagaatttcccaaactgcctttacatgcaagtacacagatggcagttaccggagcagaaggagcaagactgttaaagaaatttggagtttcaagagtcgtaacagcaagggaactttcgctttcggagataaaagaaatcgatgagcagacaggagtagaaattgaaagttttattcatggagctttgtgttacagttattcaggaatgtgtctgttttcaagtatgttagggggaagaagcggaaatcgtggacgctgtgcccagccctgccgacttccttataaggtggaatgttatggaaaaaaaacaggcagccaaaaagaggaatatccgttaagcctgaaagatatgtgtacgattgaactgcttcctgaaattttaaatgcgggagtgtactctcttaagatagaggggcgcatgaaaaaaccggagtatgcagcaggagtgacccgaatttatcgaaaatatctggatttatatgagaaaaatccagcatcctatcatgtagaaaaaagtgattttgaagaattactggaactgtatcaaagagatggatttagtcagggatattataggcagcataatggaaggaatatggtggcacttgaaaatttaaaacagcagaagaaagaaaaaggagtatgtcaaagagatgaagcactttttcatacattaaagaaagagtacacagaaaaaaaacttcaggaaaaaataaatggaactttaatgctgtatacgggagcaccggcaattttagatttggaatatgataagattcgggtgtcagtcgagggtgacagattcgagatggcgcaaaatcaggcactgacacaagaacgcatcagaaaacagatgatgaaaaccggaaatacaccgttttgttttgaaaatctggaaattcagacagatgaacagggatttcttccgatgcaaagtttgaatgagctgagaagaaaagggctttctttgttaaaagagcaatatcttaacagttttaaacgtacacttcctgaaaaaacaggagagcagaacaataattatgcagaatcaaaatcatcagagttagaaacttcagaagaaatttattattatgcatcagttgaaaccagggaacagctgtctgcggtactcgagcgtccagaaataacgggagtttattttgacagtacattggtgtggggaaactcagtagagcagaaattagatcagatagtcgaaaggattcataaaaagaaaaaagaagcctatctgatgcttccttatatattaagaaaagagaaaacagaccagataagaaaattaattgagtatagtgcagaacgtctggagggatttttgattcgcaacgtagaggaactggggttacttgaaaaaatggggctcttaaatcaggcagtctgcgattttagtctttatacgatgaatgatgagtcgaaatgcttttttgataaaaaaggagtcaaaagaaccacgattcctcttgaattaaatgagagcgaaatcaaaaagagagagaacagtgacagcgaaatgattatttatggatattatccgatgatgatttcggcacagtgtttaaaaaagacctgtgagcgttgcgaaaagaaagcagatattgtaacattgacagaccgatacaagagcagattccgaacaaaaaccgtctgtgatttttgctataatgtaatttataacagtattcctaccggttttcttcaggaagaagaaaagataaaaaaacttggaataaaaaatctgagaatcagtctgacaacagagagaaaacaggagtcaaaagaactgcttgagttgtttcttggagtttacaaaaataaaaaaaacgtgccgaaaaatgttttagaatttacaaagggacattttaagcgtggagtagagtaggtgaaaatttgattaatttgattgttacactttctaaatatttacttttgattttaattgcactttatactttagagagttttattgtttttggatatcgttatgaggaagataagagatatatcttgaagaaacagctgatgcttatctttttcatggattttatggcatttcttgtaatttttttgaaaaagcaggaattggaaattatttatttttttatagtacagttattgtattttattgcggttcagattttatatcggattttttataaaaattcatctctgcttttactgaatcatacctgtatgttactgtcaattggttttattatgttggcgagactggatatggaatcagcagtgcgtcagtttgagattgtagttattgccacaatcattgcgatggtgataccggttatgattcataaattccggttcttaaataaatggacctggttttatgcggtggtaggacttttgctcttgcttactgtgctggtgcttggaaaaaatgtaaatggggcaaaaatcaatatttcctttgggggatttgcgtttcagccatctgaattcgtgaagattatctttgtgttttttgtagcatgcagattgtataagaaaaagacggagtttcgggattatgtgattacaacagcaatcgcagcggtttatgtgttgattttagtgttatcaagagacttgggaagtgcggttgtattttttattacttatgtggtaatgctttatgtagcgacaaaaaaaccgctttatctgtttgcaggactgggatctggttctcttgcagcagtagtagcatactttttattcagccatgtaaggcaaagggtgatcgcctggaaagacccgttttctgtttatcaaagttccggttatcagattgttcaggggttatttgcaatcggaacaggaggatggtttggaatggggctttgccagggctcaccgaatatgattccgtttgtaaaacaggactatatgtttgcggcaatttgtgaagaattgggtggattgtttgcaatgtgtctgattttaatctgtatgagcctgtttgttttagtagtgaatatctcactgcagattaaacgaccgttttataaactgattgcccttggacttggaacagaatatgcatttcaggtgtttttgacaattggaggtgtaacaaagtttattccaatgacaggaattacacttccgttagtcagctatggtggaagctctgttcttagtacgattattatgttggcaattattcagggattgtatattttaagagaagatgaggatgatgaacttgagagacagaagagatgagcagcgcagatggcaagacgagaagcgcagagaacagcaggcgaagctcacagaaagaagagcacgagaggctaagaaaatacgaaatcgagaatatacgatagtaagttacttttttgtttgtatttttatttcattggttgtctatatggtatattttgaattggaaaaaaaagacagtattatcaacagtccgtataatacaagacaggatcagtttgaagaccgtgttgtgcggggaagtattttatcggcagatggacagacgcttgcgtatacacaggtcaatgaagatgagacagagacaagaatttatccgtttaataatctgtttgcacacattgtcggatatgattcaaatggaaaaaacggcctggaatctctggcaaactttgagctgatgacatctcatgacggctatgtcaagcaggtcaaaaatgaaatgcaggagacgaagaatcagggagataatgtggtaacaaccttaaacacttctcttcagcagaccgcttatgatgcgctgggagacaatcagggagcagttgttgtgatggatccgaaaagtggagcagtgctggctatggtaagtaagccggattttaatccgaacactgtttcacaggattgggattatctgaccagtgattcttcaaacagcagtttgttaaatcgtgcaacacagggagcttatccgccagggtcagtttttaaaattgtgacaacacttgcttatcttagaagtgaaaatggaaatctggataattttacttatacctgtgatggaagtattactgtagatgatcatactatcagttgctatgatggagaagaacacggaacggaagactttgaaacagcgtttgcgaagtcctgtaacagtgcatttgcaaatcttggtatggagcttggtgctaaaaaactgacgagtgcggcagaaagtctgctgtttaataaaaagcttccgatttctatcagttataacagcagtaaatttgatttaggagatcacccgggaaatccacttttaatgcagacctcaatcggtcagggaaatactctggtttctccgatgcatatggcattaattgtaagtgcaattgcaaatgatggtgtgctgatgaaaccatattatattcagcaggtacaaaatgtaaatggagacgttgtaagcaagacaaagacgtcggagtataaaacacttatgacaaaagaggaagcttccagattaaaacagttgatgcaggaagttgtaaatcgcggaacagcttcggctttaagcggagaaagttattctgcagccggaaaaacaggctctgcggaatattatggaagcgatggaagtattcatacacattcctggtttgtgggaatggcagaaaatgacgaatcacagcttgtcgttgcagtaattgcagaaggagcaggaacaggaagttctgtagcagtgccgattgcccatcagatttttaatcaatattattattaattcttaatcgtaaatccttgcacaggttctcaaaaagaggtatactaaacacaatgaaacacaacgctgaccgggaaacggtttttacaggaggacttgcaaaatggttgaagcaacgagctgtggcggggtggtaatatatcgcggaaagatactgaccttatacaaatcctacaaacataaatatgaaggatgggtattgccaaaagggactgtagaagaaggcgaagactataaggatacggcgcttagagaggtaaaagaagagtcgggagtgacagcaaatattattaaatatgtgggaaaaagtcagtatagtttttgtataccggaggatacggtagagaaagaggtacattggtatctgatgtctgcgggaagttattacagtaaacctcagagagaagaatactttgtggattccggattttataaattccatgaagcataccatctgttgcggttttcaaatgaaagacagattttggaaaaggcttataatgaatacttggatttaaaaaaagcaaatctttggggaaacagaaagtatttttaggggagaagggactggattatcagtcccttctatgctatcaggaacatactttgggaatccgagagtacataggaatagtaaggaggcaaagactatgttagaacagattgacttgacaaaaactatggaaaaagaggcttatcgtgaagaaatagcacagatggaactgactcttgcaagaatgcaaagagcatgtaaagaacagaaaatacctgttattatcatatttgaggggtttgatgcagcaggaaagggactccagattaacaaattgattcatccgttagacccaagaggattccacgtatatgcaatgaaaaaagagacaaagacggagcagatgtacccgtttttgtggcgcttttggacgaaaaccccagaaaaaggaagaattgcaatttttgatacaagctggtatcgtcatgtatccgttgatttttttgaaaagaaactgtcaaaagaagaacgaaatctggcatatcaggaaatcaatacatttgagcggactttaacagatgatggtgcggttttgataaaattatttcttcatatcagcaaaaaagatcagaaaaaacgttttgaaaagctgcttgagtcgaaagagactgcgtggcgtgtcagcagggaggatttagaacgaaataaaaattatgatggatataaatcaattttagaaaatatgctggaacagacagagacggaatatgcaccatggacgattgtggaagcaacggataaaaaatatgcaactgctaaaatttatgcaactgtaattcaccagttagaagaagcactgaagaagagaacagtgcaaaaagaggaaaaacagacagaaaagcaggagaagaagcaaaagctgtttgaggcttctgttttaagcaatgcagatttaagttgttcttacacaaaagaagaatataaagaaagactacaaaaactacagaagaaaattgcggttttgcacagtgaactgtacagaaggagaattcccgtggtcttaggatttgaaggctgggatgctggtggaaaaggaggagcaatcaaacgtctgaccgagtttatggatccaagaggctatgtcgtaaatccaacagctgcaccaactgaagttgaaaaaaaccatcattatttatggagattctggcagaacatgccaaaagcaggacatattgcgatttttgaccgtacctggtatggcagagtaatggtagaacggattgaaggcttctgtacaaaagaagaatggcagagagcttatcgggaaatcaatgatatggaagcacatcttgcgaattccggagcaattgtaatgaagttctggatgcagattgataaagatgagcaggaaagacgttttaaagagcgtatggaaaatccggaaaaacagtggaagataacagacgaagactggagaaaccgggaaaaatgggaacagtatgaagaagcggttaatgaaatgattattaaaacatcgacctcttatgctccgtggacaattgtagagggaaactgcaagtattatgcaagaattaaagtattggagactgtagtaaatgaaattgaaaagagattaaaaaagacagattaggaaaagtatatgttaaactggtataaaaatctgtatattggcgataatgcaaaaaagaaatcaaagaaactaatacacaaaattaatcagggagcaggtgtaattgacgtgtatgtcattgcacttgcggttaatcctgaaaattcattggaaatcttttcagcaaatttattgatgcagagtgcgcttagacgaaattgcccgacgattatcgggcttgcaaaagggtatgaagaggcacttgagattatagagcagattgtaaatgaagtttatcaggagactgggacagcggaaattcggacatggcttgaggcacgaatagaaaaaaatggaaggaagaagaaaaggagtaggacatgatgtggatacatattattttggtacttcttaagataatcggaatcttgcttctggttgttgtatctttacttcttttagcaattttttcaattttgtttgtgccggttcggtatcaggcttatgggtatcgtgataatcaaattagtaaaggaataataagagtcttctggctggcgcgtttgatttcttgtaaagtcagttatgacagttatggaaagaaaataaagtggtctgtaagaatttttgggatttccatacagaaagtaacggcttggaaaaagaagagaaaaagcagaagacaaaatacgaagagaaagaaaacgcagacaaaaaagacggaaagaaaagaaacagaaaccgtattaaaagcaaaagaactacaagagaacatagagcaggaacagaatcagaatgcaacagaggcagaacaaaaaagaaaaaaagttaaagatattgaacagaaaccagagaaagtggagagaatagaatcagaggaaaatcagaaaagaaaagagggcaaacactcgccgatatcaatatttttcaaaaaattaaaaaaaatattagaaattccccgaataactcttcgaaaagttaaaaaaacttggttaacagttcatgggatttgtgataaaataagcgaaatccgaacatttttagagtccgaggtatttttaaatgcaaaaacattattacttggagaggtaaaaaaacttgggcttcatattcttccaagaaaagtacaaggagagattgagtttggatttgatgacccttctttaacggggcgtgtactggcagttgctggtatctgttatccgctttatggaaataatattaaagtcaccccttattttgataggaaaattttggagggtgaactcaaagtgaaaggaagaatccgtggaattgtacttttaaagagtgcgttaaaagttagctttaatcaagaagtacgagaaatctggaaaaattttaaaggataaaaacagtgaaggaggaagcaggatggcttcagaaaataactttaaggcaaccgtagattctttgtttaaaggaatggatagctttattacagctaaaacagtggtaggagaggcaatcacggtgggcgataccattattctgccactgattgatgttacttttggagtgggagcaggagcgttttcacaggataaaaaaaataatggcggtggcggaatgggaggaaaaatttctccaagtgcagtgctggttatctcaaatgggacaacgaaattagtgaatattaaaaatcaggataccgttacaaaactgcttgatatggttccggatctaattgaacgttttacaggagagaaaaaagaatcaaaggaaaatgaaaaagaagattccgtagaaagtttggtaaaagatattgtttcttcagcagataaaaaagaagaaaacgagagtacaaaggaagagtagaatagataaaaaactgttgtgaagtacattcatgacggttttttgcatatagtaaagtaaaccataaaggagcggagagttgtgtgctgcttacttggatttttgctattttggctgggagcggggatgtttctggctctggtttttccgaaatgtttttttatggtgctggcagcagggctgtgtatgctgataggatataatcttttttgtggaaaaaaatagagaagatttaatgagagaaagagtaataatagatataaaatggaacatgaaaaatgtcggaaagaaaaagagtccggaaatcaattccggactcgatgatgcgaaattacgctctttctactttgttgcttcttaagcaagaagtacaaacgtacatcttcttagcagctccgttttctgttttaactttaacagatttaatgttggatttccacattttgtttgatcttctatgagaatggctcacattatttccaaaatgagcagctttttcacaaattgcacacttagccatgatagcacctccttaaactaaaataagtccgtgtatacaaactcacaacactagttattttaacagatgatttgattttttgcaagtaaaaatataaattttttaaattattatttcgtttttgggaaagatatgttagaatagttctatcaaaaaggtatggaggtgtccgtgcatggaaggacttgtagatacaggattaggaaaaatagcaattgatacagatgtaattgccacttatgcaggaagcgtagcagtggaatgttttggaattgtaggcatggcagcggtaagtatgaaggacgggcttgtaaagcttcttaaaagagacagcctgaaacatggaattaatgttggaattactgataataaaatcactcttgaatttcacgtgattgtggcatatggtgtaagcatctccgctgtatcagacaatctgattagtaatgtgaaatacaaggtagaggaatttaccggtctgacaatagaaaaaattaatatccttgtagagggtgttagagtaattgattaattaaggaggaaacttgttttgaataccaataccgttgatgcaaagatgcttggcagaatgtttttagccggcgctaagaatctggaggccaaaaaagaatggattaatgaactgaatgtatttccagtaccggatggagataccggaacgaatatgacacttacaattttgtcagctgcttcagaggtcaatgcactttctgaaccatctatgaaaacactggcaaaagcgattgcgtcagggtctcttcgtggggcaagaggaaattcaggtgttattctttctcagcttcttagaggatttgcgaaggtaattgagcagtatgaagaggtggatgcaccaatttttgcaaaagcgtttgaaaaaggtgtcgaaactgcatataaagcagttatgaaaccaaaggaaggtacaattcttaccgtggcaaaaggagcagcagcaaaggcagatgaacttgcagaagaagcagaaaatttgaacacgttctttgaaggagtaattgcttatgcacaggaagtgctttctcagactccggagatgcttcctgttttaaaagaagctggtgtagtagactctggcggacagggtctgcttgaagtattgaagggtgcttatgatggatatcttggaaaagaaatcaatatggattttgaagcaccaaaaggaacggcagctgtttctaaacaggctccggcagaagaaagtaatattaaatttggttattgtacagaatttattattatgctggaaaaaccgttcccgattgaagaggagcatgcatttaaagaatatttgatgtcaattggagattcactggtagttgtagcagatgacgagattgtcaaggtacatgtacataccaatgaacctggaaatgccattcagaaagcgctgacttatggacaactctccaatatgaaaattgataacatgcgcctggaacatcatgaaaaagtaataaaagaagcagaaaaaatggctgcaatgcaaaaagaacaaatgccggaaaaagaagttggatttatttctgtatctgtaggagatggaatgagcgccatctttaaagatttaggagcagattatctgattgaaggtggacagacaatgaatccgagtacagaagatgtactggaagcgattgcaaaagtcaatgcgaaaaatatttttgtatttccaaataataaaaatattattctggccgcaaatcaggcaagagatttgacagaagataaaaatattattgtcattccgactaagacaattcctcagggaattaccgcattaattaattatgtgccggaaaaaacaattgaagagaacacagaagaaatgctggaaagcatcacaactgttaaaacaggacagattacctatgcagtgcgtaatacaaagattgatgaaaaagaaatccatgagggagatatcatgggaatcggagaccatgggattttggcagtgggacaggacgtagaaaaaacaaccttggaaacagtagaagcaatggtggacgaagactcagaaatcatcagtatttattttggtgcagaagtaagtgaagaagaagctgaagtactcaaagaagcattggaagaaaaatatccggactttgatattgatgtaaatcagggtggacagccgatttattattatgtaatctctgttgaataaagaatgattaagaaagaaaaggaaaaaagatgtttgtacaaaaattgtgcggacatcttttttgtacgggtgaaaaatggaaaaacaggaatccattcgtaatttaaaaggaattggcgagaaaacagaaaagctgtttcatatacttggaattgatacaatacaggatttattggattattatccgagggaatatgaacaataccggattccggtatctgtttctatggtgcgggcaggagaaaagattgcagttttgggaaaaatcacgcaaagtatcagcttaagaaataccggaaggctgacacttgtgacggcaacgctaaaagaagcaggacgggaattacagcttacatggtataatatggcatttttaaaaaagacgttagtttttgggggtacttatatttttcgaggtgtggtatctgaaaagaaaaacagactggtaatggaacagcccgagattttcaccaaagagcaatatcagacaatgcagaaccgtttactgccaatttatagcctgacaaaaggaatgacgaacaaaatgatagcaaaaatggtacgtcaggttttagaagaaaaagaaatcgaacaggagtatttgtcagagaagataagaacttcctgtcagttagcagagtataattacgcagtgcaagagattcattttccaaaaaacagggaaaatatgattctggcaagaaaacgactggtattcgatgagtttttaatttttctcttatcagtccggcaaatgaaagaaacggttaaaaatgagaaaaatttatttgggataaaaccggtgtcagaaacggaggctttgattcagagtcttccgtattcgcttacgaatgcgcagaagaaagtatggcaggaaattcagaaagatatgacaggagaaaaactgatggcaaggttggtgcagggagatgtgggaagtggaaagacaattcttgcgtttctggcaatgctattgtccgcacaaaatggatatcaggcagcacttatggttccaacggaagtattggcagtccagcattttgaaggtttaaaacagcttttagaggaacatcagcttgattttgaagcggtattgcttaccggttcaataaaggcaaaagaacggcgggaaatttatcagaaaattgaaaatgggaaagcaaagctgattatcggaacacatgcactgattcaggagaatgtaacttataagaatctggcacttgtcattacagatgaacagcatcggtttggggtgcatcaaagagaggatttatcgaaaaaaggcaaacgtccgcatgttttagtcatgagtgcaacaccgattccgagaacgcttgccattatgctgtatggagatttagacttatctgttattgatgaactgcctgcaaatcgtctcccaatcaaaaactgtgtggtggataccagctatcgaaaaagtgcgtatcgttttatgcaaaaagaaattgcagagggacgtcaggtttatgtgatttgtccgatggtagaagaaagcgaagggctagaatcagaaaacgtactggattacacaaaaaagttaagacaggaaatgccgccagagatttccgttggatttttgcatgggagaatgaagccggcggaaaaaaataaaattatggaagaattttccgaaaataaaattcagatactagtctccactaccgtaattgaagtgggagtgaatgtgccaaatgcaacggttatgatggtagaaaatgcagaacggtttggacttgcgcagttacatcagttaaggggaagagtcggaagaggtgaacatcagtcttactgtattttcatgcagggaggaacaaaaaaagaaatcaaagaacgacttcagattttagtagaatctaacgatggattttttattgcgggagaagatttacgcttaagaggtccgggggatttatttggaatcagacagagtgggattcttgaatttaaactggcagatatttatcaggatgcagctattttaaaggaagcttctattgttgcagatgaaattttagaaaaagacccgcatctggaatcggaagaatataaagggttaaaaaacagactggaattttatgcaaaagagcagatgaaacgacctggaatctgatgggaatcagaaaaaacttgaaaaaaaaggtaaaatggtttatgataaacgagaatcatgtaagggctacataaaggaggagattagtatgcctagaacaaaaacaacaaaggctgcagttacaaaaacaacaaaagcagctgtaacagaaaagactactccagttaagacagaagaaacagtaaaaacagaagaagtaaaagatgtagaaacaaagtcagaagaaactaaagcagaagaaacaaaaaaagctgcatcatctaaaaaagagccggtaaaaagagcaaccagaaaaagaacagcaacaacgaagaaaacagctgtaaaaaccgttacaaagagagtgaatattcagtttggcggaaaagaccttaaaatcgaagagattgaagcagctgtaaagaaagcctggatggatgaaaccggtaaaaaagagacagaaatcgaaaaacttgaaatttatattaaaccagaagaatctgctgcttattatgttgtaaacggcgaatatgtagaagaaggaaagaaaatcgatttataagactataaaacgcaaagtaagagggaagcttcttaagtaaagaagcatccccctttttgattttctttctttttagagattagaagaaccgctggacatctgacgttcctggttttcaatcatttttttcaccatatagcctccgacagaaccgttctgttttgaggtaaggtttccgttgtatccatctgtcagagggacacctaattcgcttgcaacctcatacttgaatcggtttaatgcacttttggcttctggtacggctgtactgttagaagaattactgttagacatggttttcttcctccttttgtcgtctgtttttttgttacaatggtagtatgtgaaattctattttttttattctggaaatgtttacaggttttgacaaattatgagaattgtattaaaatatctattcagcaaaagaaacgctaagaaaattatgtattttcaatctgatattgtaaaaaatgcataaaatgcaaaaaaataattgcggatagttgttgtatttgctataataaatctgataaaaaaaagaagaggatggttgaatatgaacgttggtataattgcacacaacagtaagaagcctcttattgaagatttctgtattgcatataagaatattttggcaaagcatgaagtttatgcaactggtacaacaggaagaagaattgaagaggtaacaaatcttcgcgtgcataagtttttgccaggaagtatgggcggtgataaacagattacggagatgatagaacgtggagatatagatatggtaatctttttttacaatccttctatgattaatccaaaagaaccggatgtctatcagatttcccgttgctgtgaccagtataatgttccgattgcaaccaatattgcaacagcggaatctttaattctcgggttagaccatggggatttagactggcgcctgaacaagtagagaagaggatttaagctgaatatgagagtaattgcaggaagtgcaaagggaatgcccctcaagacagtttcaggaatggagacaagaccgaccacagacaggattaaagaaacattatttaatatgcttcagtcctatatctgtgactgtcggtttctcgatttattttcgggaagtggagccattggaattgaagctttaagcagaggggcagtttcttgtgtcttaatagaaaaaaataagaaagcagcaaactgtattctggaaaatctgaaatttacccgtctaaaagataaggcggaagttatgaaccaggatgtgtttactgctctttccatgttagaaggaacagaaccgtttgactgtatttttatggacccgccatacaataaagaactggaaaaagaggtgcttgcagtgctaagaaatgcttcttatgtaacaaaagatacgttaattgtagtggaagcatcgttagagacaacatttgattatgtggaagaatacgggtttgaaattgtaaaaaataaaaaatataaaacaaacaggcatgtattcttaaggaaggaataaaaataaaaaatggtaagagcaatttatccgggcagttttgacccggtaacttttggacatttagatgtcattcgacgtgcatcggaactttttgacgaagttatcgtcggagttttacataattctcaaaaaagtccgttgttttctgtggaagaacgtgttaatatattaaaagaagtgacggcagatatcccgaatgtaaaaattgagacctttagtggtctttcggtgaattttgcccgaaactgtgatgcaaaagtaattatccgtggactgcgggcaattacagattttgaatatgagcttcagatggcacagacaaaccgtgtgttggcgaaagatgtggataccatgtttttgacaacaagtctggagtatgcgtatttaagttctactacggtaaaagaagcagcatattttggtgctgatatatcaaaatttgctccggaatatgtagtagaaaaagtgagagaaaaatttgcacaaaagggtaataaaatacaataaggagtgtaattatgagtagcagaattgagcagattattgaagaaatcgaagaatacgtagaaagttgtaaataccagccgctttcaacaacaaaaattgttgtaaataaagaagaattagaagaactgcttcgtgaacttcgtatgaagacaccagatgaaatcaagagatatcagaaaatcatcagcaataaagatgcgattttagcagatgcacaggcaaaagcagatgcagttattgcagaaacaaaaacacaagttcaggatatggtaaaagagtctgaagtaatgcagcaggcttatgcacaggcaaatgaaattgtaaacagtgcaaatcagcaggcacaggcaattattgactctgcaacagcagatgcaaataatttacgtttaagtgcaatttcttataccgatgagatgatggcaaacttagaacagctgattcatggaacgatggaaaatgcaaatgcaagatataatgagcttgcacagacttataatgcatttgcacagtctcttcagagtgcggcagatgtggtgagcgaaaacagaagtgaacttgcacctcagttaaataatccgattccgaaacagacagaagaagagccggaagaaaatctcgatatggatgatttagacgacgagttagaagaggatgacgaataaaaaagtaagtcctgaggcaatgagggtacaaacgattcttccgattagataaggaaagagagggaggtctgtgcctgaaagtacgcaggaagtctgagcaagtacgcaaagacctccaaagctggaaaagcccattgtcaaaggaaactttaaagaaaatggcagagcagtgtcttttaaagcattaagtccggtggaaaattctgttagaccacaaagcatgactgaaaagaaagacgaagaagacagcaggaattgaaggattccttgaaaaacagaaaacagaataatatatccaccaagcttggtaatagaaaaaaggctattcataatagagatatccagaagttccgcaaaaggagaagaggatgtctctttttgcgttcgggtaaatacagattgctgagaaacagagtaaatccggcgaaaaaaaagactggtaagaaacgcagacagaaaaaagatgaaaaaaagcagatgattgggaacctgattttctaaaatagaaaatgataaatatccggtcagaaaagaagggcttggaaaagcagaaaatgtcaaaagatagcaggcttcctgtttggaaattttattagattggtataaatctgctgtagtttttgcacccattggaaaaccgcataaaattccaaataaaaatgcagaagcaccaaagggggtaagagaaaaaacagaatgccagaactttttgaaagatacgagaagcggttcaagcagacccgaagaaattaaaatggcggataataccattgcaggaaataaagagggcaaaagtgtagaaaaccaaagccggatgcccaaaagagccgaagaaatacaaatctgtggaaataacaaagaaaaaagaaaacaaaaaagacaaaaaaaagaaaaaaacagacgtttcataaatagattctccgatctctgattcaaattcacatcataatatatggaacgggtgaaaagaatatgtccttgccatttggaaaaagatgtgacacaataagaaagaataaaaagtgtgtctgcactgcagattaccttggatatggaggcagaaaatggcagtattagaaaatttaaaaccagaaagagtgttttactattttgaagaaatctgtaatattccgcatggttcaggaaatacaaaacaaatcagtgattatcttgttgagtttgcaaagaaaaaagaacttcgttttattcaggatgaaatgggaaatgttgtaatttttaaagaggcatccaaaggatatgaagagtcaccaacggtaattttacagggacatgtagacatggtgtgtgaaaaaacagccacgagtcagcatgattttgaaaaagacggtttaaagctgtgcgttgagggtgatgaaatctatgcaaaagatacaacgcttggcggagatgatggaattgcagttgcttatgaactggcggttttagaagatgagacacttgcacatcctgcgattgaggcagtgtttacggtagatgaagagattggtctgttaggtgcagaaggatttgatacctctgtgttaaagggaaaatatctaatcaatctggattctgaggcagaaggatatttatggagtggatgcgctggaggacttaggagttacagtgagcttccggtaaaacgtgtggaaggtacagggctttcttgtaaaattacagtggatggactgcttggcggtcattccggctcagagattaataaaaaccgctccaatgcgatacttcttctggcaagatttttgcatgagtgtggaagtgaattagacttgtttttatatgatatgaaaggcgggcagaaaaataatgcaattccacgacaggcagatgcagaagtattagtttcagcagaagatgccggtcgattagaacagatggcaaaagtatttacttctacccttcaaaaagaatacacaggcagtgatgaaaatatccaagttcatgttgaagtacaggaggagagtacaaaacaggtacttcatccggcgagtcaggagaaagtattatttttcctgattcattatccaaatggaatccgcaagatgtgtggatttatagaaggactggtagagacctcctgtaatgtaggaattgtgcgcttgatgccatcaacctttatctgtgagacaagtgtgagaagttctgttggttcagaaaagagagcacttgcagaccagattcgttatctgacagaatttctcggtggagaatatgatgaagacggaaactatccggcatgggagtataaaaaagattctgtacttcgtcctctgatgaccaaagtttataaagaaatgtatcaaaaagaaccagtggttgaggtgattcatgcaggattggaatgtggtctgttttatgaaaaaataaagggactggactgtgtttctatcggaccggatatgaaagatattcatacttcggaagaacgcctttctatttcatccactaaaagagtatatgaatatttagtagaagtattaaagagaattaaaaagtaactggaataaaatcccttttccgttcatagaatgataagtgtgaacaatacgaagtcaacttgaatggataagggattttatgatttctttctggtatggatgtaagaaatatgatatacttaaaacacgtatgcgtaaaaaacagattagaaaaaaagcgcagaaagtctgttgatgattccaaggcgcaatgacaaggagtaatgatttatggaaatacgtttatggcatgagcttttgcttccttatgagcttgccgtgaaagaaatggtaatcaagttcaaacatcttaaaaaggaacacagggaaaaggaactttattcaccgattgaacaggtcagcggacgagtaaaatcaatcaatagtattcttgagaaaatgcagagaaaaaatatttcatgggaagaacttgaagaaaaagtagaagatatcgctggaatccgcattatctgccagttttctgaagatattgaaaaagtggcggatattattcggaaacgtcaggatatgagggtactggagataaaagactatattacgcatatgaaagaaagcggttatcgaagttatcacatgattattgcttatcatgtagagactttagaaggaccaagagaaataaaagcggaaattcaaattcgtacgcttgcaatgaatttttgggcaacgattgaacattcgctgcagtataaatataaaggaaatatgccgcctcatgtaagaacacggttaaataatgcggcacagtcagttttaactcttgacgaggagatgtcatccgttcgtaatgaagtgatggatgcacagaactctatggttcaccagtccaatattgtaaaagaaattttaaataatattgagaatctgtatcattattcaaataacagagaagtggcaaaaattcaggatgaattttaccgcatttatgaatcaaaagatttagcacgcttagagcgttttcatcaagagttagatgtaattgcagagggataccgtgcgcaggcggttgcgacagaggaaatcttgtaacagcaaaggaaaacttatgagactaccagagaaatatgaaaatgaaatgaaagacctgttgcaggaagaatatgaggcttataaagaaagcctcggtcttccgatacagcagggatatcgaattaatacaggaaaaatcagcaaggaggagtgggaaaaaatcgctcctttttctgcgaaagaggttccatggatagaaaatggatactttcttttagatgacttcagagcttccagacatccttattattttgcaggtctttattatttacaagagccgagtgcgatgacaccggcaaacaggctaaatgtagaaccgggagattttgtactggatttgtgcgctgcacctggaggaaaagcaacagagcttggaagccgtttaaaaggaaaaggcatgttagttgcaaatgatatcagcaacagcagagcgaaagcacttttaaaaaatctggaactggcaggaatagccaatctttatgtaacaagtgaagaaccggcaaaactttgtcaaaatttcccggaattttttgataaagttttaattgatgttccttgttccggagagggaatgttccatagagaacccaaaatgatagaatactgggaaaaacgaggtccggaagaatacgttccaattcagaaacagcttattctgtatggaagccgtatgttaaagccgggagggaaactcctttattcgacctgtacgttttctaaaaaagaagatgaagaggtgatacaatggctgttggaacaaaatacagacatgcatctgatttctattgctccttatgagggattttcaaaaggatttggattatcagaatgtgtgcgtatttttccgcataaaatgtctggagaagggcattttttggcattgcttgaaaaaaaatctacagaacaagacaacacacagaaacaaaaactgcaaatgggaaaagaattgaaactcccaaattgcgtagaagaatttttttcattattaaagtttccgattgacagaagttgtctgaagttggaaaaagaacgattgtatctgctgccaaatgcagtgaagatgccaaaattgcgttacctgcggaccggattgttgttaggagaagtaaaaaagaaccgctttgagccttcgcaggcattggcaatggctttaaaaccggaacattttgcatcttgtatttcaattgacagtacagatgtgcgctgtgtgaaatacttaaaaggagagactttagacgtctcagaccttccctgcaacaataaaaaaggctggcagttagtctgcgtggaacggtatccactcggatttggaaagttaagcaatggcattttaaaaaataaatactatgccggatggagatggcagtagatggcacaaataagaattgataaatatctggcggatatgggaattggaactcgaagtgaggtaaaaaaaatcttaaagtccggtcaggtaactttaaatggagaaaaaatcaaaaaaccagaacaaaaaattaacagtgaaacagacgaagttttagtaaatcagaaaccggtggtctatcaggaatttgagtattatatgcttaataaagctggaggagtggtttctgcgacaaaagataagaaggaaaaaacggttttggattgtatcgattccaaaaaacgaaaggatttatttccggtaggtcgtctggacaaagacacagaaggattactgctgattacaaatgatggagaactggctcatcgtttgctctctccaaagaaacatgtggataagacttattttgtgaagttaagagaaccgttaaagcaggagtatgaagcggcgcttgaaaacggaattgatattggagaggaagcattgactttgccggcaaaacttgaaatttgttccgaagatagaaaaaactgtctgcttacaattcatgaaggaaagtttcatcaggtaaaacggatgtttcagtcagcagaaaatgaagtggtatttttaaaacgaatgtcgatgggaagtttaacattagataaagcattagaaacaggacagtatcgtccgcttacacaagaagaaatagagaggttgaaaacgaatgcttaaaaacataaaagcagtattgtttgatttagatggaacgttggttgactccatgtggatttggaaatccgtagatgaagagtattttgagaaaaaaggacttgttctttcctcagatgagattgattcattccagcaggaattagagggaatgggatttacagaaaccgcagtgttttttaaaaagcgatttggaattgaagattccctggaagaaataaaggcagcctggatttccatggcaactgaaaagtactgtaatgaagttccgttaaaggatggagtaaaagaatttttagaatatttaaaagaacagcagatcccgtctgcgatttgttcaagcaacagtattgaattgattaaaatggtgttaaaggcacatgaaattgataattattttaccaaaatgataacctgctgtgatgtatcagcgagtaaaccggcaccggatgtttatcttgcagcagcaaaagccttaaatgtaagtcctgaaaactgtctggtatttgaagatgttccaatgggaatcttagctggaaagaatgcaggtatgaaggtatgtgccgttgaggacagttacagtaaagaacaaatggaacaaaagaaaaagcttgcggactattacataaaagattacgatgaggttttaaatcagacatttgaggtgttaaaatgatgcagtttttaccggttacgatgaaagaaatgcaaaatcgtggaattagtcagccagatttcgtatatgtctgtggagatgcctatgtggatcatccgtcttttgggatggcaattattacaagacttttagaacattatggatacagcgtgggaattattgcacagccggactggaagaaaaaagaaagtgtctgcgtatttggagaaccaaggctaggatttttagtctctgccggaaatatggattcgatggtaaatcattataccgtttccaaaaagcacagaagggaagactcgtattctccaggagggaaaatgggtcttcgaccggaccgtgcagtaattgtgtatgggaatttaatccgtcagacttataagcataccccgattattatcggtggaatcgaggcttctcttagaagactggcacattatgattactggtcagattctttaaaacgttctgtattattagattcaggagcagatttgatttcttatggaatgggagaacgcagtatcttagaaattgcagaggcactcaatcgtggagaagatatttccactctgcatcatattgcaggaacggtgtatcatacaaaagaagcacctgcgggtggaatcatccttccttcttatgaagaaatgtgtgcagataagagaaaatatgcagagagttttcaggttcagtatgaaaatatggaagcgttttcaggaaaagtattggcagagtcctacggaaatcgtgggtatgtggtacagaatcctccctcaaagccgttatcccaaaaagaaatggatgaggtttacgatttaccgtatatgaggacctatcatccgatgtatgaaaaactcgggaagattccggcgattgaagagattaaattcagtattacaagtaacagaggctgttttgggggctgtaatttctgcgcacttgcatttcatcagggaagaattgttcagacaagaagtcatgaatctattttaaaagaagcagtggaatatacaaaggaatctgattttaagggatatattcatgatgtaggaggtccaaccgcagatttcagacaaccagcctgtgaaaagcagctgaaaaaaggagtctgcacgaaccgtcagtgcctgtttccaaaaccttgtaaaaatttaaatgcagaccatgaagattatctggaattattggaaaaactcagaaagattccaaatgtaaaaaaagtattcatccgttccggaattcggtttgattatgtggaagcagacaaagacagtcgctttttagaagaactggcaaagtatcatgtaagtggacaacttcgtgttgctccggagcatgtttcagaccgagtgctgtcttatatgggaaaaccggaacatcaggtttatcagaaatttttagcagactttgaaaaggcaaataaaaaaaccggaaagaaacaatatgtggttccatattttatgtcctctcatccgggctgcaccttaaaggatgcggtaaagctggcagagtatgtgcgtgatatgggatttatgccggaacaggtgcaggatttttatccaacaccatctacgatgtctacctgcatgtattatacagggattgacccaagaacgaaaaaagaagtttatattccgacaaatccacatgagaaagcaatgcagagagctttgattcaatataaaaacccacagaatcgtgaactggtaaaagaagctctgataaaagcaggaagaacggatttgattggatgggagcataaatgtctgataaaagaaggaaaaaaaacggtacaggcagaaaaagatttcaagaaatcaaccgtacagcgaaaaaagaaaacgattcgaaatgtgcataaaaggaaaggaaaataagatgaaaatagcaattgtaacaggagcgtcttctggaattggtgcaagttatgtctgtcagcttgcagaaaagtattcatggctggatgaaatctgggtcattgccagaaatgaaacggcactctggacactgaagcgacagtgtatagtgccgctccgtgtttttgctatggatattactcagacagaaaatttgctgagactggaagaagaattagaaaaagtaaaaccgtatgtgaaatactttgtaaatgtagccggatgtgggattaataaaaagataaaagagacagatttgatggattgtaaccgtatgcttgaagtaaactgcaatgcattgaccctgcttacgaaaattgtacttccgtactgtggaaaacgaagcagaatcgttatgttagcttctgcttctgcttttttgccacagccgggatttgctgtttatgcggcgtcgaagtcttatgtgcttagtttttcaagagcactgcgcagagaattaaaaaagacaggaacgaccgttacaattgtatgcccaggtccggtagatactccgtttttagatacaatcggcgggaaagatagcattccggttatcaaacgaccatttattatgaaaacggacaaggtagtttcagtcgcaatcaaagatgcggcaaaaggaaaggaactgtcgattccgggaatttcaatgaagtgtttttttcggatttgtaaaattgttccgcataaagtattgttaaaatttacataaaacaagacaagaacaagatacataaaaatgaggaattacatgaataaaaaacaaaaaataaaaaaaggtgatttcggatatattcagtcacagaaaaagaagcgtacgatttatacgattttagctttgattccaccactgacagttttctttgttggctggattatcaataaagacaggaatacagtatttactgtttttgcagcggtggggtgtctgccggcatgtaaatttgcagtcagcgcaattatgatgtatctgcaaaagccaatgtcagaggacgattataagcagattgagcagcataaagaaggtttggtgtgtgcgtatgaactgccggtttctgcttatgaaaaacagacctttttagattccgttgcagtctgcggaaataatgtggttgcatataccagccgtgagaaatccgatattccgtttgtggaaaagcatattcagaccattttaagacaaaatggatattatgtaacgataaaggtattcagacgtcttccggaatatttaaatcgtttggattctatgtgggagcatcatgagtcactggaagaaggcattcgatttgtgccggatgaaaataatccggatttaagcagaaatgagctgattatgcatactatttttgcaattacgctttaggagaaataaatgaaagaattagaagtaaaagcgcaggaaagcggacagcggtttgataaatatctttccagatatttaaaagaagcaccgaaaagctttctctataagatgcttcgtaagaagaatattacgttaaatggaaaaaaggcaagcggaaatgagaaactcgaagtgaatgataaagttcagttgtttttttcagatgaaacattagaaaaatttatgggagaagaaaaagaagtgaaaaaaggttctctcgaaattctttatgaagatgaaaacgtgatttttatcaataaaccggcagggatgctttcacagaaagcaaaaaaagaagatgtttctttaaatgaatatctggcgggttatctgcttgattccggagcgatgacaaaagaagatttcagaacctttcatccggcggtgtgcaatcgtttggatcgtaatacgagcggaattgtagcagcaggaaaaacaatggcaggacttcagacaatgacgcagttgtttcgggacagaaatcttcataaatattatctggcactggtaaaaggaatcgtaaaagaagaagctcatattaaagggtacttaaaaaaagatgaaacttcgaataaagtaacgattaccagacagccacagaaagatacagttttgattgaaacgaaatacactccgattggatgttcaaaagaaaaccggctgactcttttaaaggtggaactgcttaccggacgttctcatcagattcgtgcgcatctggcaagtatcgggcatccgattgtaggtgatgcaaagtatggagatatgcaggtgaataaaaagtatcatacacagtataaagtaaaaagccagcttcttcattcctggaaattagtactgccacagttagagggtgagctggcaaatctttctgatatggaaattacagcgccggttccaaaggtattaaaacagattattacaaaagaagtgaaaacagcagaaggagagattggatgagcaaaaaatatgaaggtccttctatgatggaagaactgtgggaatatgtaaaaatgattgtgttcgtagtggtaattgtttttattatcaataatgttttgttaattaacgcaagaattccgtcagaatctatggaaaaaacgattatgaccggagacagggtttttggaaatcgtctggcttatatgacaaaagacccggaacgttttgatattgtgatctttaaatttccggatgatgaaagtcagctttttatcaaacgagttattggacttccgggagaaacagtaacgattaaggatggtaaagtttacattaatgattcagaagaaccattagacgacagttttgttgcggagacaccggtaggtgattttggaccgtataaggtgccggaaggaagctattttatgcttggagataatcgaaatcattcccgagattccagatactggattaactcctttgtagaaaaagataaaatccttggaaaagcagttttgcgttattttccgtctccaaagctgataaaataaatgtgttcttataattttttgtgttgagtttgtgagaagattttgagagtacaaaaaatgtacggtcggaaacaaaaaactttgaggggatataagataagagtggaggcaggaaattggcaacttggaactcaaggggactgcgaggttctgcattagaagaatttattaatcaaacctgtgaacagtatcgtgaaagaaatctggctttaattcaaaaagtgccgactccgattactccggttcggattgaaaaagaaagccgtcatattacacttgcttattttgacaagaaaagtacagtcgattatattggtgtagtgcagggaattccggtctgctttgatgcaaaagaatgtcataccgataattttcccttacagaatattcacgaacatcaggtgcgatttatgggagattttgaaaaacaggatggaattgcatttttgattctgtatttcagtcatagagacgaaatttattatatgagatatgaggaaatgctaaaattttggaatcgtggacaaaatggaggacgaaaacactttaagtatgaagaattgaatccgaaatggtttttaaccagaaacggaaattacctggttccgtttctggagggaattgccttggatttaaaagagagagaagagaattaatttttctctgtggtttctcttggaattaagacaggagaaataattttatggactggctcgcaaaaagccggtctttctttttgcgcttgaatttgtgagattaataactcaacggcttcaaatgcaatcttgtcaatctgctgactgacgctgctgattggaataatagcttctcgtgaaatcggagaatcgtcaaatgcaattaaaaaatagtcgtttggcagatagccatactttcggattaacagatttaaaaatacatttgcataagtatcaccggagataaaaattccctttcggataccggaataattcagttcaatttgttctaaaatatgagttaggtggctttttacttcttcgtgggaagctcccatctcttccataaaagtatgatgtagtaattggtgtttttcacaataatcatcaaatgcttccactcgtttataagcaggagttgttcgggttgttggagcactgatatgcaaaaatacttcacagtcatgggaagagagattttcacaggcgagaatcgttccttgatagttatcggaattgacacttgagatataaacatcttcccgctctacagcaactaatggaagatgaagatttgccagttcaatcgagggaagtgtgtgacttaagataattaatccttcaatcttataagctaaaagttcctgtaagtaagttctttcatcttcttttgagccattgctgataaaaaccagaaatttatagccaaaagcttcataggttgataaaatctgatttaaaatctcagaataataacgaacatataagtttgggatgatgatgccgataaattcggtacatccgttcgccagaatttttgcaactttattttctttataatttaatttttcaagtgcctctgcaataatgttccgattttgttccgttaaggtctccggatgattaaaataacgggagattgtagtttttgaaaagtttgtatattttgcaatgtcactgaatgtgatgttgttttttttatttgccatagtaaaataccgcctttctaaaaatcagtatatcaaaaaaaagaaaaagagacaatggaattttataaagtaaccggttttacaaaaatgacaaaaatccgaataaaaattgataaaaatgctgaaaaatacttttattattgagatatagataggtttgtgatagaatacagtatagaaaaaccggttactttacaaaacgaaattaaaaaatcagattctgggaggaaaaaatgaataaaaaagatatgatttttcaggaacgattaaaccgtcatcacgacgaacttcgctggctgtatatggaactttatggaaatgacgcaatgtttgcagaattatgtgaccagatgtatgagtattacaaagcaagaaagcaaaaactgcataatcgtgatgcaaaacgaataaaagaagcagagtggtttaagaaaaaagacatgcttggaatgatgctttatattgataattttgctggaaatttacagggtgtacagacaaaactggattatttaaaagaatgtaacgtaaattgtattcatctgatgccgtttttagattcaccggaaggacgttctgatggcggttatgcagttgcagattttcggaaagtaaaaccagagcttggaacaatggaagatttagcaaaattaacggatgcctgtcatgcaaaagacatgaatgtgtgtatggattttgttatgaatcatacatcagaagaccatgaatgggcgaaaagagccagaaatggagaaggcgagtacatgagccgttacttcttctatgataatgatgaaattccaaaacaatatgaaaaaaccgtaccacaggtctttccgacaacagcaccgggaaacttcacgtatcttccagatttgaatcattatgtattgactaccttttatccatatcagtgggatttaaattataaaaatccaagagtatttaatgagatgatgtataattttctgtttcttgcgaatcagggaattgatgtaatccgaattgacgctgttccgtatatctggaaagaattaggaacaccgtctcgtaatcttccacaggtacatacgattgtacgaatgatgcgtatgattggtgaaattgtatgcccaagtgttatcttacttggagaagttgtcatggaaccggaaaaagtagtaccatattttggaacagtggaaaaaccggaatgtcatctgttatataatgtaacaacaatggcaacaacctggcataccgttgccacacaggatatccgcctgctgaaaaaacagatggatattgtaaatgaacttccaaaagaatatctgtttttaaattatttaagatgccatgatgatattggctggggacttgattttgaaacactcaaagattatggaatggaagaaattgcacataaacgctttttaaatgatttctttaccggaaaaacacaaggaagtgtaagccgtggagaactctataacgatgaccctgtcacaatggatgcacgtttctgcggaacaactgcatcgatgtgtggaattgagacagcattaagagaagataatgctgaaaaattagaagaagcagtccgcatggatgtgatgcttcacgcatatatgctggtacagtctggaattccaatgttatacagcggagatgaaattgcccagttaaatgataaccactataaagaaaatccacaaaaagcagaagactcacgctatattcatagaggagcatttttgtgggaaaatgcaaaaaaacgaaaagagaaatattcggtggaagaaatcgtatttgattccctggcaaaattagagaagataagaagaaatgagactgtgtttgatgcaaaagcagacgtgtatacttatgatgtaaaagagaataaaatccttggaatcttaagagaagatgagaatacaagatttattgccctgtttaattttggaaatgagccacggacagcatggatgcaggaagaaggcgaatttgaagatttgtttacaggaaagaagattgagttaaaagatgtggaactggctgcacatggatttgtgtgggcggtgagaagaaaataagaataagagcaaaaagagaaacagccggaagagtatatatagaaactctgaccggctgtttttctgctcatagacagttccagtttgaacgattaaaagttaaaaaattttgaagcaaaaaatattcttcaaattccagtatgataatattgaactacaaaaaatattgtaaattatttttagaaaaaaatctagtagttatattatactggattaaaatatattgggtatttttgaaacaaaatatattaggaatatattgcaaaatagaaagtttaagagtataataaaagaaaaaaaggagtgatgcaggtgagaacagaacttgtttttgtgttaaaaaagccaatgataagtctggactatcgaagaatgattctatcatggttaaagcgaagtcttacagagtgtaatcagggaaaatattatgaacgatattttcggttagatgctccacaaaaagattattgctttactgtgctaatggattctccgaaatttacaaaagaaaagatattgttaaaagaaccaagaattcgggtaatattttccgcagatgataaaaatcggagtggattaatattttttgcggcgtttttagctatgaaaaataagcagtttccattaccggatagaaatgccatgactttacgaaatgtaataagaaaaaatgaagcattgattgcagaatcttccgttatctttcggaccagcctgggaaatgggttgtgtattcgagaacatgacagagaaacgaatagagataagttttttacctgtgaagacccagaatttaaaaagaaaacagaagagatactgaagatacaggcaagacttgctggttatccagaatctatggttcagacgataaaatttactccgattcagtgcaaaaaagtattagttttcttctatggtcgatatgtcgatgtaacgaccgggattctacagttagaaggagaacctgaattattacagtatttttatttggcaggagctggttcaaagcacagcgcaggctttggccagttgaacattttaaaataaatcaggaaggaggagaagttatgggactagagagaatagaacctctggattggagatattccgcagcaattgtaggactaaaagaatatctaacttggtgtggtgcatcagactggaagttacaagatgaatatctggaatataattcggaatctattacagagtcagattatttgaagtttgtggaacagaaatattcagaagatatgcatcatgtattagctgaagaattactattagaagaaaaaccaagtgaagaacagatgaaactgataaatgaaaagctgactgcaaatacagttttaaaaaaaatatttggaaaaataaaatacgatggaataaatcgggaacagatacaagaattaatagaagaaaatcgtgaagaaattgtaaaagagacctatcgaaataaagtaaatctgtaccgaaactattgtaatacaaatcaattatttgagccaggtaagaattgttgcagactactggggtattatgtagatttaccaaaaaaaggcaaatccatttcttataattttgatatggcaaattttgtatacgaggacactccgatatttgattttattccatttgcattttgtggagaacgagatttttattttataaatgataatgttgatttaagagagttagttaaaaccaataagatactgcaagataaaataaaaaaagcaagagaaaatgcaaggcaagagggaaaaacaattgattccagacagatttttttccagactattattgaatcaaaggattttatgtatcatgatattgagattatacataaaaacgttgaaaagacacattttgaaacattatatttaagtaaaaagagcctggatattttacagaaattaaatggagaaaaaacagacaaaaaaccatataaagcattttgttttaaaataaaaataaatgataattattatctggatgtatttaaagaaacgatgaactgcattgtgaatcttattttgacagatgagtggataaattatcttttaaaaaataatgcaaacggaaattacacttatgtgttataccaattaataaaagtaaatttatggataaaggaggatgcagatatggaagctggaaataaaagagcctatggatgtgcaaaggcagttgctaagaagaaagataaagtaccggacaacaaactgatttcgtttcgccaaaaactgacgagtgccttgacctttgaagattatgaccgattttgtgatattttattaaatttatcaaattatgcagatgaaccatttgattttgcatatgatttatttgaagattttgagaaaaataaagaattagcgtatacatttgtaacagcgctgagaagagataataaaaatgtagaggagacaaaagtatgaaaaagaattctttaacattaacggtagttgcaaatatgacatctaattattcggagtcactgggaaatattgcaagtgttcagaaagtatttaagaacagaaaaatctattctatgagaagcagagaaagtttaaaaaatgcaattatggttcagagcgggatgtatgatgatttagaaacaagtctggatggagcagcacagaaaaaagtaagtgaagaattaaatgcctctaattgtcgtgcgttagaaggcggttacatgaatacacagggaacaacttatgtaagaaaaagctctttttatttgacagatgcagttgcagcagagcattttgtaaatgaaactcgttttcataataatttatacttagcaacgaattatgcaaaagaacaggggatttccgtacagagtaatggtggaagtgcaggacttatgccatatcagtatgaatacgataagagtctgaagatttacagcatgacaattgatttagaaatgataggaaaagatgaaaatttccatgaagaggcagatgcaaaagaaaaggcagaacgtgtaatcgcacttttggatgcagtggaaaatttatctttagtcgtaagaggaaatctggataatgcagagccagtgtttgtagtaggaggattatccgaaagaaaaacgcattactttgaaaatgtagtgcatgtagaagaagaaaaattgattttatcagaagatttaaaaataaagctggaaaaaggatttcaggcgggacttttacgtggaaatttattgcaaaatgaggaagagatagagaaagaactggcaccggtatcagtacctgtattttttgaaaatctgagaaaacaggttttggattactatctggaaaaataaaagaaagatggtgtaaagatgagcaatttaaaaactgcagtacggataaaattacatcagacaagtgcgaattatcgtagagaagaaacaatagaaaataaaatgacttatcctcttccacctatttcaacagttattggggctcttcattcagcctgtggttatacggaatataaagagatggatgtcagtattcagggaaaatttgcttctatgcacaaagaaccatatacagattattgttttttaaattctaccatggatgacaggggaatcttagtaaaaatgagaaatgcatctatgctttcaaacgcttttatcaaagtagcaagtgcgaagaaatctcaaggcaacagttttttaaaagggattacgattgatgtacatagttcggagttattagaagaatatagagcacttaagaaacttggaacagaaatacaagactataaaaaaacagaatataaagagaagataaaagagtttaaagagaaaaaaaaggaactggcagataagaaaaaagcaattggaaaaggaaatgctggctttgaaactgtggcagaagaagaaaaagcgctaaaagcagaagagaaaaaatatcaagagacagttgcaagatatgaagaagagaactataaaaaaccagttgcaaaatttcgaaccgtaacaaaatcaatccgatactatgagattttagaccagatagatttgattatccatgttacagcagatgaagaaatcttagatgatattttggaacatgcttatgatttaaaagcgattggtcgtagtgaagattttgtggaagtattagatgtgcagaaagtacagttggaacaaggaaggagcagagtaagaactttaaatagtgcatatttaagttatgatgatattgttgctggaagaattagaacaggagctatgagtggtcggaagattgcaggtactgcctactatttgggaaagaaatatgatgctaccacaggtaaaaggatatttttagataaaaaaagggttgtttatacatctaattttaatattgatgaagcttctggaaatgtttggatagataaaacagagaaaccattttatattgtgaattttttataataattaataaagtaagaagtacagaaaaggcatggcagaaaggaatcttgttcatgtcttttctgtttagggagaaagcaatatgaaagcaatacaggattttttagcaaaaccaaataagacaattcgggaacattcagatgacttgaagaagcgagtatattatttgaaagaaataggatatataaaaggagaacgtttgttttatcttttattggagtgttgtaaacatcatgatgatggaaaagcgaatttttcctttcaaagacgtgtatccagtaaaagatggattccgtttgatccagaaaaagaaataccacataatgtattatctgtgtattatttggataaaacacagtatgaagaaatggattatttaaaaattgcgagtgcaattttatatcatcatgattattgtgatgaagatagagtgataaatgagaaatggatgttgatagatgaaaatcttttagaaggttatagcagtgaatctttaagcggagatgaaattgaatatttaatgaatgaaggactttatggcgaaaatcttatcatattaaaaggtcttttgcgaagatgtgattatagtgccagtggagaatatgaaattgaatatccaaatgattttttgcttgaaaaattagaacgaatgatgcaacgctggaaagaaaaaaatgaaaatgctggttggaatgagttacaaaagtttgcaatagaaaacagggaaacggatataattgcagttgcgtccactggaatgggaaagacagaagcaggtcttttatggataggagaccaaaaaggatttttcatactgccggtgcgaactgcgattaatgcgatttatgacagagtaagagaagaaattcttcaggaagaaaagcttgaagaaagagtggcgttgctacattcagaagcattggaatattataatgataatgttgaagaacttgatattacggaatattttgaccgaggaaaacatctttctttgcctttaagtatttcgacattagaccaattatttaattttgttcttcgttataaaggctatgagacaaaattagcaactttatcatattccaaaatagtaatcgatgaaattcagatgtatgaaccagatttactagcagtattaatccgtggattaggacagatacatagattgggtggaaaaatcgcaattgttacggcaacactggctccttttataaaacagcttttaaaagaggatgctgaaattgaatttaaagaaaaagattttattttagataaaacacgtcatagtgtgagtgtaaaatatggtgcaatacaggcggaagatattgttacacaatatttggaaaataagaaatctggaaaatctaataagattctgattgtttgtaacacaataaaaaaagcgcaggcactgtatgaagaattaaaaactcagttgggagaaatagaagaattaaatttattccatagtcgttatatacgacaggatagaaaaaagctggaaaaagaaattcgcagatttggaaaaacatattgtgatgaaaaacataaaatattagattgtcagaatggaatctggatttctacgtcacttgtggaagttagtttggatattgattttgactatttatttacagaattatctgaactaaacggtttgtttcaaagaatgggaagatgtaatcggaaaggtgtaaaaaatctggataaatataactgttttgtttattgcgcaggagaagaagtaaaaagaggacaaaaaggatttttagacccaattttttatgaacaatcaagaaaagcgttacaagaagtggatggacttttaagtgaagagaagaaaatggatttaattaatcggtattttacgatggaacaggtaaaagacagctcatttatgaaaaagtatcgagaagtttataatcaacttatggaattgcggattggtgattttgaggaaggagaacaattaaggagtatttttaatcaggatattattcctaaattggtatttgatgagaatagggagtttattttagagcagcaggaccgattaagaaaaatagaaaaacagcttagaaaaagtaaaggagaagaaagagtacagtatttaaaggaacgattaaactgtcaacaaaatttaaaagaatttgtagtttcaattccaaagtatgaataccaaaactatatggaaaaaatctgggaaagatttggatacgttgtaataagtaaatatgaaaagattccgattatggattgttattatgatgaaaaagggtattatccattaaattataaagaaaggacaatagaagatgaaatgatgatgtgttagggggaaatttatgaaagaaaaagtaacaggaactatggtttattattattttgtctgtgaaagaaagctttggtattttagtaatgaaattaatatggaaagcgaaaatgagagtgttatattaggaaagctattagatgagggcagttttaagagagatgaaaaacatattaatattgatgacacaattaatattgactttattcgtgaatataaggaactgcacgaagtaaaaaagagcaaagcaattgaagaagcaggtgtctggcagacaaaatactatttgtattatttgaaacaacggggtgtaacaggattaaaagcacggattgattatcctctgttgaaacagcacttagatgtgacattgaataaagaggatgaagaaaaaatgaagataatattggaagaaatgataaagatttgtaaaaaagaaattccaccagaattttcatctcaaaaaatttgtaagaaatgtgcataccatgatttgtgctttatttaggggaggaggtatttgattttttatgaagcagagtttttatgtatataataatggagatttaaaaagaaaagataatacactgcgatttacttcgtatgaaggacaaaaaagagatattccgattgaaaaaatctccgacatttatgtgatgtctgaaatgtcatttaatacgccattcattagctatatttcccagtatggaattacaatgcatttctttaactattataattattatgtaggaagttattatccgaaggaaagccttttggcgggtcagttgctgataaagcaggtagagcattatcaagattatgaaaaaagattgacattagctaaaaaatttattgaagcagcagcagataatatttatcgaaatctgcgttattataaggcaagagaaaaagatgttttaggtgctatgcaggaaattgattatttaaggcgacagctatcaaaagcagaaacaatagaagaattaatgggaatagagggaaatatccggaaaacctattattcagcctggaatgaaattgtaaatcaagaaattaaatttgaaaaaagagtgatgcatccaccagataatatgattaattctttaatttcatttgtgaattctctgatttatgcaaaaacattaagtgaagtgtatcatactcaattgaatcctacgattagttatctgcatcagccaggtgcaagacgtttttctttatgcttggatttatcagagatttttaaacctcttatagcagatcggttgattttttcattacttaatcgcagacagattacggagaatagctttacaaaagaatttaattttcttcacttgaagaaggaggcatcacagttaattgttacagaattagaagcacgtttgaaacaaacaattatgcatagagatttaggaagacaggtttcctatcaatatttgatacgcctagaagcatataaattaattaaacacttaattggcgaaaaggaatatgaaggttttcggatatggtggtgatagatagatgtatatcgtgttagtgtatgatatcagtcaagacgaaaaaggacaaagaagatggtcaagaatatttaaaatatgtaagaaatatctgtctcatattcagaattctgtttttgaaggagaaatatcaaaagcacagttggcgaaaatgaaaaatgagttaggaccttacataaataatgaacttgattcagttattatttttaaaagccgtcaggaaaaatggttagacaaagaatttcttggtaaggtagaggataaaactggatttttgctgtaaaaaaattgtcgacctccgataatgtaaaaatatggggaggtcgacaattaaaagaacgtaggaaatgcaggaaaagatgaaaaagaattaagaggaaaatcaaaaatttttgagaaaaagtgagaggtcgacaaaaaagggttgaaaaactaagagaaaagtagtagtgtataggcacggatattaatagaatcacagtggaatttaaattgccttacccccgtttatccggctgggctttcgcccatattaatagaatcacagtggaatttaaatgcctttacgccctgcctcttaagcaccgctgctgatattaatagaatcacagtggaatttaaatgcttttatcaatgcttcaattctgatccggtctgcatattaatagaatcacagtggaatttaaattcctttgttatttttccggtcttcccgttaatcacaatattaatagaatcacagtggaatttaaatgacaagatgagtccgccttcgtcaacttcatcacctatattaatagaatcacagtggaatttaaattattatgaaagattagaaaaggaaggtgaatattaatattaatagaatcacagtggaatttaaatacatcacacagacaacagttcattgtgtccaaccttgcatattaatagaatcacagtggaatttaaattgaagaagcaaaggaaaatgcatcacagttgattcaatattaatagaatcacagtggaatttaaattagaaaccaccttcacaatactgaattgggtttgtatattaatagaatcacagtggaatttaaattaaacctgagcacctccataaacctgagtatcatcaatattaatagaatcacagtggaatttaaatgtcgttacggttacttctgttgttataaagcttagtatattaatagaatcacagtggaatttaaatggaaaactcatgataaactcattatcttgatacaatattaatagaatcacagtggaatttaaatgacggacgtatcgaatagaaaacaagagtaccgtatattaatagaatcacagtggaatttaaatgttaaccatgttgcgccatctgcgcccttagctccggatattaatagaatcacagtggaatttaaattaacagcgatattgtttaaatttaactaattatttatattaatagaatcacagtggaatttaaattgggtcaaactgttccaatgattcttctacaacatatattaatagaatcacagtggaatttaaatgagattaaacgtttcttaaaagaatcatcttcatctcatattaatagaatcacagtggaatttaaattcatttctcttaactgctgttccgacactgtacagatattaatagaatcacagtggaatttaaataccggacccatacgcctaaagagcaggattaaaaaaatattaatagaatcacagtggaatttaaatgttctaaagatgattaacactttaatcggtcgacttaatattaatagaatcacagtggaatttaaatgcaaatagcgtgtttgataactatcagtatgaagtacaatattaatagaatcacagtggaatttaaataccctcacgttttgatacgggttcatgaggtctgtgcatattaatagaatcacagtggaatttaaatcatatcatcaaattcaggcggtttgactgtcgcttcatattaatagaatcacagtggaatttaaatttgcaccgccctcaactgaaaggaatctgaatacaatattaatagaatcacagtggaatttaaattgtagaaattgcctcaccagtctgcacaatgtcctatattaatagaatcacagtggaatttaaatcttgtagatgtcgaaacatgggataaagtaaatagatattaatagaatcacagtggaatttaaattttttcaatgtagaacactttgacctcatgggttctatattaatagaatcacagtggaatttaaattgattcccccgccgttttcttcataggcggttttcaatattaatagaatcacagtggaatttaaatccctacctcaatcttaactattttcatccacaaaaaatattaatagaatcacagtggaatttaaataatcgtattgagtcaaattgtaagtcttaatctgaatattaatagaatcacagtggaatttaaattctaactgttgaagtacctcttcaattccggcataaatattaatagaatcacagtggaatttaaatttgcttgcgatgccaataacatctttaaactccggaatattaatagaatcacagtggaatttaaatgtatacttcactttgtcaactaatgttacttcaacatattaatagaatcacagtggaatttaaattgatgatggttttgatgttcatatttacattcataaatattaatagaatcacagtggaatttaaattgtgatcagggcgaatacagaataacggcaggcgaatattaatagaatcacagtggaatttaaatttgatgacaatcttcaatggtgcttgttctttcttatattaatagaatcacagtggaatttaaatttatttaattttgattcataattatcgagccattttatattaatagaatcacagtggaatttaaattttcgaaatttccatgctctcgttttcgttcggcatattaatagaatcacagtggaatttaaatccatttgtattaaaatgcagttcaattacatttgtatattaatagaatcacagtggaatttaaattcattttgatatatctgcaaatcaatacttctttatattaatagaatcacagtggaatttaaatgtaacatcccgcagtatcctgaaaataatctgtaataaatattaatagaatcacagtggaatttaaattctggcattgcagtatcaagttcaatgttatttacatatattaatagaatcacagtggaatttaaataagtgtatcaacctgatcaggtgtaaacggtgatctatattaatagaatcacagtggaatttaaattttgaagatgatctaatttaacatcaacgaagcgcaatattaatagaatcacagtggaatttaaattgatttataaggtggttacggttgtctacggttaaatattaatagaatcacagtggaatttaaatttggcaagattttcacctctattcgtttgttttgaatattaatagaatcacagtggaatttaaattcctttcctgcccccttttgagtgtgttcattgtttatattaatagaatcacagtggaatttaaatcatttcgccatctcgattctccagcgtttctaatctatattaatagaatcacagtggaatttaaatacacaagaaaaaacagtaaattatacaaatcagagtaatattaatagaatcacagtggaatgtaaattcgttcttttctacattgtccaagaactctctatattaattgaaacatagtggaatttaaattctgtcgctttgcaaactacgaaatcgcatggtacaatattaattgaggtgtagtggaatgtaaatgcctttttcgttggaataaaattaacgatatataaaaaagtgtatattatagactaagagaggtgaaaaaaatgcatacagatgttagagaatatataagattgtgccgtgtaaaaaaaggaaatatggcagaggctgaacttgctaggagaacaggacagacagcgcaaaatatgaataataagtataaacgaaatacgtttaaaatttcagaactacagaaagtggcagaagccctggatgcagagttgaagattacatttattgacaaagaaacaggtgagccgattatataaaaatatatctgataaaaaagtattgaaaatatataaaaaaataatatataccgattatatcggaacgggaaaggcaaccgatataataagagaaagagaggtaaatatgaacgtgaagatgtcagaaacagcaagacttatcttgggcttgcgagaaagagggatgagcgatacagaaattacgaacttaattttatttgtagagactggagaggagcagtataagccgaaaaaagaaagcaaagaaaaaaagttaaatagaaaaaatcggtcaagggtagaaaaagggtagaatttgccgccacctttgctagaaaaataataacagaaaattagaaagaaatcatattaatcgaagcagagtggaatgtaaattacgttgatgccgtactttttgcaaatttgtcgtttacgaaaagtgaggtagataaaatgctgatacaatccgcagaggaagaattaaaattttatgaaaaattagatgctataacaacaaaagaagaaagattgaaagtagaaaaagagttaaaagataaaagactatcttttaaaacgagaagaagaattaaaagagtatccatttgctcattgatactgccgatataacgtctattaagagaaagataataaaatttaaagcagaaaggaagaacgaggtgaagtatgagagcagacgatgaccttacatatcaggaatataaagatagtgtagaatctaatatgagcctaataaaacattctggatggactccgaggcaggttactgactggatgacagaggaagataatgaattatttgtcggaacatcagaagcactttggattatttccattggtgcttatgaagtggagcatgatatcttagaagaacgggtattagaacagttgtcatatcacattccacgttatgagatgggaaaatatgacgatattacgccggaggaaagaaaacttttggaaaaggatattgagtatattcgttctaaagtagaattgtggaaattaaaggattatgattagcgataataagtaaagtattaagtaataaatcatcattaactgatggataaggattagtatatattgataaagaatttgaaggatggatgccaatgtgcaaatttgaattaagtcaagaacagattgaatttttaaagaaagaatattcagaaaataatttgatacagaaagttctggaaacagagaaaaataaagtttttgaggtagatgtagatactaaaattgattttatggattttgtcgaagacgaatccatatattggatggacgaggactacgaggctacaccaaagactattatgttggagtcaataagagatactatatactatcaaacaaattgaggatagataggtttaaaaatattgaggggcgtatacataagtggcataatgttcttatcaggaggttggaaaagatgagaaaatataaaaaagaaaactaggataaaacctatctattataaagtatgaaagcattaaattttttaggaatattttttattagtattggaattgtaaaatgtagtatttatttcatattaaagaaatgtagaagatattagttatggaagaaaagaaagtatgtccgcaggataggtgggacaaaaaagcaggcgttgtatctaaaacttataaggttaatgagcagattgcaaaggagtatcagcttgcttgtaaaaaagcaggagtagcaatgggaacgcagttaacgaaaatgatgagcgcatttattgaagaagtgaatcgtgaggaataaaagataatgaaaaaaatattttatccggcaatttttcatccggcagaggaaggcggattttgggtaacgtttccagatttaccagaatgtataacagaaggtgataacatagagaaagcgtataatatggctaaggatgcacttgaattggcgttgacagattatataaaagaaaagaaagaattaccaaaatcatctgatattagtcatatcataatcaaagaagatgaaaaagttatgaaaattcaatttaatcggtagcgaagcagattgcaaatatccgtttggctcaaagtggaatataaaattgttgcagttacggccaataagagcaacagcagttatgctaatagattcataatggaatgtaaacgttgatgctgaaattatccagagcgcagcagtgccgtatattaatagaatcacaatggaatgtaaataacgctgtcagtgtatctattaccatgtctgttatatagttttaatcccctcaaactggaatattaaaatattgtgaaaattgtattacatattcagaaaatttttaaaattaagatttattaagactaattttcttgtcgaatcccttcaattatgatataatttctgttaagattacagactatttaaaacaagtaatgaaggtgaaaaaataagatgtttgaacacaaaaagataaatacattaaatgattttttcatagaacttcataaaagaccagaggaaggaatttatttttaccgacttaatggctattcgaatgaaattaaaacttttattcaaaattactacgaatccgcaagaagagccggagttgtaattgagggaaaaattccaaatccggatgaaaaaaatctggcatattataatgaaatcatgggaatggattttcagatgaatccggcatttattgaagctgcacttaaaaaatggcttccaagaatgaatggttttcagagaaaaaatgttgcatattctatttatgatacattagatagtttaagaaaatccggaaaaaatgaaaatatgctcaaaaatgcatatattaaatttatgtgctggctttattataagtttgagaggattgtgaatctgcttggaacagagaaaatacccaaaattttgtatgagggtgaaatcagtcagtatgaactgcttttaattgtggtgttggcaaaagccggatgtgatgttgttttacttcaatatcatggagataactgttatctcaaattggattcgaccagtcagttgtccgaggaatggaaagccccagatctaacaaattttccagctgattttagtttgaaacagttaagaacacagatgcaggaagcgtttgaacgagaacgtttatatggaagagcttcttcttataaaaattgtacaaatgcgtggatagagggaaaggctttagaggatatacaaaaagatgtctcaacgagaggggcagataacagcttcttttataattgttattgtctgataaatggagtggaagataagctgacatatgcaaatcaattgtttttgttttaccaaagcatagcagaaagtaagcgaaatctggttgcaatagatgagaaaattccacttccacagccagaggaaatttcatctgtcagaagaaaaaattatatgaatttagaacagatgttattggatttatcttttaatttaaaagttcctgaaaatgtagaattgcagagactattgataaaagcgtttatggatgtgatgttttcggagagtaaaaagtcaggagtgaatttaaaccgtttgctgaatcaggcagtgtatctgctttgctggactaagagatatcaaagtatactatttaaaaactggaagatgcctgagattgcctgcttcttttatatgacggcgcaggttacagagaatgaagctctttttcttcggatgttggcgagacttccggtagatgtattgattttaaatccacagagaacaggaaagggagagttggaagatcctttattatatgaagaaaattattctgaaactttgaatatcaaaaaaattccaagggaaaatgtagatgttcagatgggaaccgttgcatatcaggcggaacgagaactggatacgattttatatcaggataccggaatttatcgaaatcaacagtatcaaaatgctagtgtgattaatttaaaaacaacgtacgaagagattggaattttatggaaagaggaattaaaatatcgtccgaatttcagtactacacaggatattgtcaatcttcctgtgatttttgcaaaagtgtgtggcataaaaaacggagatgaaacagcatattggacttcaataaaagaattaattacagaaaatacatttgtagtaaagcattttccttttttacaggcaacggatgaaaacctaatgaagccttatgcaacagaattttggaaaaatgagagacttcataaaaataagataaagaatcatccgagttatccttatgcaatgcttcgagaggagatgcaggattatattttagataagctggagcagttaataaaaagcagggttattagtggaacatttaaaaatgggacagagtatacgattgtatcgacggttttaaatctgccaaaggaagtagtaaggctgttacaggcatttgattttacaaaagaaaacccgaaagcggttctgattcacacaggagaaaaaatgatttcactggaggataccattttaaccgcatttttaaatctggcaggatttgatgtggcgttttttgtaccaaccggttatcagagtattgaaaaatattttaatcgtaaactatttgatgaatatcagataggagagtataaatatgatttacaaattccggattttaatcattttctgggaaatacatgggtaagaaaatggcgggataaactattaggaaaaggagtatgaggtatgggacttgattttggaaaaccagagacaatgacaggttctgttattgttccggaaaaaaatgagatagaagaggtaaaacaatatgatattgttgcagaccgtcagcagttaaatacgacactcaccaactcaaaagaagtagatgatattgtcagtacaattgaagtctataatttagacacaattgtatcgtttggttctgaagttgcagaagaaatttctcgtgcctctgatgttgtgttaaataatacaaacatgtcgcaactggatgattccagtgaattgttgaatacactcacaaaaattatgaatcagtttgatattgatgagttgaaagagaatccgggtctgtttggaaaattgtttgggaatttaagaaaacagctggataaaattatagataaatatcataccatgggggatgaagttgataaaatctatgttcagttaaagaaatacgaagcggaaatccggcaatcaaaccgaaaactggatgaaatgtttcaggcgaatgtcaattattatcatgagctggtaaaatatattctagcaggagagcagggctgtaaggaaattgaaaattatatcgccgagcgtcaggcggatatggaagcaaccggtgatcagtcaattcagtttgaaattaccagtctgaatcagtccttaatgatgttagagcagagaactcaagatttgcgtacagcagaaaatgtggcaatgcagtccattccaatgattaagaccatggaatttagtaatatgaatctggttcgaaagattaattcagcgtttatcattacacttccggtattcaagcaggcacttgcacagacaattatgttgaagcgtcagcgtgtgcaggcagaagcaatgtcggcgcttgaccagaaaacaaatgagttattaatgcgtaatgcaagaaatactgtagagcagtcaaagctcacggcacaattagcttcagggagttctataaaaacagaaacactggaaaatacctggaagacaattgtaaatggaatagatgagacaagacagattcaggaaaatgcaagaaagcagaggattgaagaccaggcacgattggagacaatcaaacaggaattcaaccagaaatatcatatgccgaatcagtcgtataaataagattgaaaataaaagcgcaaggaggaaaaaacgatgccaattaatttatcaaaaggacagaaagtagatttaacaaaaggaaatgcatctttaaagcatatcatggtaggacttggctgggatgtcaatgcttttgattcaggttctgattttgacttagatgcttctgcatttatgtgtggtgcaaatggaaaatgcccgacagaaaaggaatttgtattttatggaaatttggagcatccaagtggagcagtaaaacatcagggagataatttgacaggtgaaggcgatggcgatgatgaacagatttttgtggatttaaaagcgattccggaaagtgttgataaaattgcctttactgttaccatttatgaagcacaggagagaagacaaaactttggacaagtttccaatgcgtatatccgaattgtagatgaggataccaatcaggagttaattcgttatgatttaggcgaagatttctcaattgagacagcaattgtggttggtgaattgtatcgtcacaatggcgagtggaaatttaatgcaatcggaagtggatttcagggtggattggctgcactttgtggtcactatggaattcaggttgcgtaaaacagaaacagtagtttaaccaaatcaagtaagtcacctgcttcaattgcgaaaagcaataagcaggggtggggacttgcttgtatcaggagggggggtaagccccttttgataagctgcgtagcagctatttggttatgagcaagtagcgaagcggattgcgaatatccacttgacaattgttttaagaatatattaaaaaaatacaggaggaaatagttatgccagttagtttaaaaaaaggacagaaagtgagtcttacgaaagataatccaggattaaaaaatgtagtagtcggactcggctgggatatcaatgtgtttgatacgggcggagaatttgacttggatgcagctgcttttatgttaggtgaaaatggaaaagtaacaaagtcggaagattttgtattttatggaaacctcgttcatccgtcacagagcgttcagcatatgggagataatcgtaccggtgcaggcgagggcgatgatgagcagattaagattgatttaacaaaagttcctgctgagatttctaaaattgcgtttactgctacaatttatgaggcagaagcgagaagacagaactttggacaggttgccaacgcatttatccgaatttacaatgaagagacaggggaagaactgcttcgttatgatttaggtgaagatttctcaattgaaaccgctgttgtttttggtgagctttataaaaatggagcagaatggaaatttaatgcaattggaagcggctatcaaggtggactggctgcgctttgtggaagctttggagtggatatagaataagaaaagacaataaaaagaaaaaaatagagtcaacaggaggacaaagatatgtcagtcagcttacaaaaaggacagaaagtaagtctgtcaaaagataatcaggggcttgcacaggttattgtagggcttggatgggatgaagtaaaaagaaaaggcggtttgttctcaagaaagccacaggcaattgattgtgatgcttctgcgattttattaaaaaatggaaaattgtgcggaaaagaggacctggtctattttggaaatcttcgtcataaaagtgatgcagtaatgcatcagggagataatcttacaggcgccggagatggcgatgatgaacagattatcgtagatttattgcggattccacaagaatatgatagaattgtaattgttgtaaacatttataaagcagtacagagaaaccagcattttggaatgattgaaaatgcatttatccgtattgtggatgcacgaggaaacagagagttatgtaagtataatttatctgagaattatgatggaatgacagctatgatttttggagaaatttatcgtcataacggtgaatggaaatttagtgcagttggacaggcaaccaaagatccaggtcttggagagcttgcaaatcgatttgtttaaccgaatcaagtggtgaagtggattgcgaatgtctgcttgaaaacgtaaagcaatcgggtatttaggaagagaagctgtaagtccggtttctctttcttttatactataaaaaactcaaaaaggagacagaaaaatgaagtacaatggtttatcagacaaggaagtcgaagagtccagaaagcaacatggctcgaatatgattcctgattcagaaccaaccacattttgggatgaattcaaggaaacttttagtgacccgatgattaaagttctgttagcaattgcagcccttatgattgcaatgtttttctttgggtatgctgagatttatgagccattaggaacgattgttgcagttttaattgttgcgtttgtatctgcaaagacaggtgttgccagcgatacaaaatatcgtgagttgaaagagagtacagagaaagataaatgtaaagttcacagaaacggtgtaattaccattattgatgtggacgatgttgtagtaggcgacaaggtacttcttcagtctggtgataaaattccggcagatggtatcttaattgatggttctcttcgtgtcgataactctgcgttaaatggagaagcagaggaatgcaagaaaacacaggcagatgaatcattccagcttgcagatgaaatcacaggagataccttcgtagataaacattctcttttccgtggtgcaattgtatttgatggagagggaattttggatgtcagaaaagtcggcttgaaaacaatgatgggaaaaatggcagaagagatgcaggaagatgagccggattccccattaaaagtaaaacttgcgaaacttgcaaaacagatttctacctttggatatattggtgcaattgtaattgcagtgctctattttgcttattttattgttttggcaggaggtccgtccgcttattttgcagagggatttgaaaatattttaaaagatttaattcaggcggtttctcttgcaattgtaattattgtctgtgcagtacctgagggacttcctcttatgatttctctggttttgatgcaaaatacaagtaagatgcttgaccataatgtacttgtccgtaaagcccagggtattgaaacagcaggttctttaaatattttattcagtgataaaacaggaacgattacaaaaggacgactggaagttgttgatttcttctttggagatggaaaatcggttgctcttagtgagttaaaaaatcatggaaaagtaaaagggcttgtggatcttgcaattggaaagaatacgcagtctatgtttgatgcatctcataaagtaattggtggaaatgcgacagaccaggcattgatgaaatttatcggagaatctactttccgtgcacttgaaagtgataaagagtgtgtaattacacaacagcagggatttaactcttctaataaatttagtcaggctagaattgaaagtcttggaaagacattttataaaggagctccggaacgtttattgggagccgcaaagcattatctggatgcagacggaacagtaaaaccgctggatatggatgtagtaaataaaaagattgatgagttggcagtaaaagcaatgcgtgtccttgcttttggatattcagagagaactatgacggaaaataaaatcaatgatgatgttgtaattattggtttagttggaatccgtgatgatgttcgcccggaagcaaaagaagcgattgcagaagtgcagggtgcgggaattcaggttgttatgattactggtgaccgtctggaaacagccgttgcaattgcaaaggatgcgggtctgttaaaaaataaagatgataaggcactttcttctgcacagttaaatgagatgagcgatgatgaagtaaagaaaatcattcctcatattcgtgtcattgcaagagcacttcctacagataaatccagaatggttcgtctgtgtcaggaaatgaatcttgttgtgggtatgacaggagatggagtaaatgactctccggcactgaaacgtgcagatgtcggatttgcaatgggaagtggaacagaagctgcaaaagaagccggtgagattgttattttggatgataactttaaatccattaaagatgcaattttatacggaagaacgatttatcataatattttgaaattctgtaaattccagcttgtaatcaatgtgacggcagtagtggtcagtgcgattgcaccgttctttggtgtagaagaaccgttaaaagtaactcatttactgtttgtaaaccttgttatggatggtttgggcgcaatcatgcttggaaatgaaccggcacttgagaaatatatggatgaaaaaccaagacgcagagatgaaagcatcatcagtaaacagatgatgggacagattttaacaatgggtctttggcttacggttgtcagttttgtgtatttgaaagcaccgttctttaaaaatttatttgaaaacgaagaacagcatttaacaggatattttgtattattcatcgtaagtgctttgtttaatggatttaatgtaagagatgacggagctgaaattttcaaaggactggatttaaatccaggattcttaaaagtgttctttgcaattattttagtacaggcagtgattgtaaatgcaggtttgattccatttgtcgtatttgattggattggtgaaatgttcagttgtgttccatttggaattaagggctggattgcagcgattcttttagcggttactatgataccggtagatttaatccgaaaagcaattgtaaataaaaaacattaaaataaaaagcagatacatggaatcgtagaggattccggtatctgctttttaagcctaagattaatcgattccaactcggattccaccgattctttcatttggctgaactaaaacagtaactggctggtgggaattccactcataagagtaagattcaccggaagcctgtccgataaagtttttccatgaaagatccgttttgatctgcggatcacagtatccacgctgggagaaccagcaaattacggcatcagggtctacacagagagtggaattactgtttacattgcttaaaacgattggatttccattgcaaagcagggcgacataagcatttggtcctgttcctgttaatgttgatgtggcaagtcctttttgagagaaaattccacagccgatgaagcgcacctgataattacagtccggtgtaaaggcaagaatattttcagattctacagaaacaacttctcccggggcaagctggtaaataacgacatgctgacctttatctgcataataagtgacagaatctccattcatggtaactttcataagtgggaagttttcaccggtcgctcttctcatcaatgagccaaaggcagcttgcgcaagactttgttgtggaccgagcagtactttttcaaaacgataatttttgtttcctgggttatctccggcaataaaagcgccggcttttacaaaaagtgtatcagaaccagaacaagttacttttaaagataattcatttacagtttcaaatgtaagcatagcaaagttcctcctaagtataagtgagtgtagcgtgagctgaggttaaatcgaacgcttatgatacattaacaccataacgtctgcaaagcccggcaaggtcttcttttaccccatttccaacagcatgaaatttccagataccattatgcagatagatttctccaatcatcatagaagtaacagattcataataatcactcattggaaagctgactaattcgtgttggttagaatctataatctggatatacgcatgttcaatcatactgaaatttaaatttcttgtaagtgcttcgtttatagttaatacaaatacgattttttgcacaacggaatttaactgatttagctgaatatgaattttttcgcattgattggttgaaagcgtttcaaatgaaacagatcgatcagggctttgtggctgaccgtaaaaaacaaaccaggaatctcctaagactttttgatttgctcctaataaaaatgcagagacatccacatcgcaggcggttttttttacgttccatcctagtagaatgtcgacagatggagaaacagagtttgtaaacagtgcaattttctgacctttttgtacgatgtttttaaaagtcggatgcctgtaagaagcaatagtgggagcgggtgaatgagagcgcaaattttggtttaattgtaaaattgtctgagaggactttgcggttcgtactttttgggtattcagcgacaaaatagtctgtgaatgaaaggcaggtattgttttttcaggaatttgaatcataagaaacttcctttcttttttacatctttttaaaatcatagtagcattttagagagaaaaaagcaatgaaacagcagagaaattgacaggaaatattgagtttctcttgtgggtatagtatgataaaaaacagaaaataaaagaaataaaaagaaaaataatgaggataattatgaatccaataattgagataacaaattttgaatttccagaactggatgtttatgcacgactgaatgaaagccagcttttacattttaatgagccaaaccctgggatttttattgcagaaagcccaaaagttattgaacgggcattaaatgccggataccatccgatttcttttttaatagaaaagaaagagataggagcacaggcagaagaaattttctcacgatgggaatctgttccggtttatacagcagaatttgaagtgctcaaacagcttacaggctttgggttgacaaggggaatgttgtgtgcaatggagcgtttatctttaaaaagtgtagaagaggtctgcaaaaacgcaagaagaattgcagtcttagaaaatgttgtaaatccaactaatgtgggtgcaatttttcgctcggcagcggcattaaatatggatgcggtattattaactccagcttgcagtgaccctctttatagaagggctgcccgcgtcagtatggggacagtatttcaagttccgtggacattttttgataaaaagaaagtgagctggccggatggaggaattcaattgttaaaagaaatgggatttcaaacagcagcaatggcattgacggatgattcggtcagtattgatgataaaaatcttatggcagaagaaaagcttgcaattgtgcttggaacagaaggagaagggttggcaaaacataccatcgcaacttgtgattatacggtaaagattccaatgatgcatggtgtggattcgttaaatgtagcggcagcaagtgcggtagcgttttggcagcttggaatggcaaaaacagatggttgttgaataagaaaatctatgatacactaaaaaattgagagaaaagaaagagcatagataaaggagaaagaaaatgccagtatttgactttagtgatacaccaaatgaaaaaaaagacccggaatgtacttatgaggttttttattcaaatgaatcagaagcaacaccggagaaaccaattttaattttagataattctgcccgtcagtggaaacatcattccggcggaatttttaccaatccaagtaagcgtacgacgtttgagttcaaagaagaagatggagttttttcggcagatatcttagagattgatgctcgttttacaagtcttttacgctggctgggagaaaaccatatcaatgtccggctttccggaaagaatcaggagaatggttatgctgtctataagattcgtgaaactgcttttggaggtggaacaaaactttcagcagaagacggatttctccaatttatgattgaccgtttgttggcaagtgatgcgccggcagaggaagtcagtgatgaagaagaggaagaagtcggcgatgatatgaaactgaccagtattcagagtattacagattttatgaactgtgcaggaaagacgatgccggataatatccgtctctgggccagacgaaatcttgcagttgcacgttctcatgaagtttcaccggaagaaagacgccatgcacaaagagcgctttctattatgatgaatattcagtggaagagtaattattttgaatccattgacccggaagaagctcgtaagattttagatgaagaactttatggaatggaacgtgtcaaacagagaattatggaaaccattattcagattaatcgtacgcatacacttccagcttatggtctgttattagttggtccggcaggaacaggaaaatcacagattgcttatgcggttgcccgtatcttaaaattaccgtggacaacacttgatatgagttccatcaatgacccagaacagttaacaggaagttctcgtgtttatgcaaatgcaaaacctggaatcatcatggaagcctttgcgatgtcaggagagtcaaatctggttttcattatcaatgagttagataaagcagcatccggaaaaggaaaaggaaatccggcggatgtgcttttaaccctgcttgataatcttggatttacagataactatatcgaatgtctgattcctactgtaggagtttatccgattgcaacggcaaatgataaatcacagattagtgcacctttgatgtctcgttttgcggtaattgatattccggattatacaccagaagagaaaaagattatcttctctaaatttgcacttccaaaagtgtttagaagaatgagtatgaaagaaagtgaatgtattgtgacagaagaagccttagatatggtaattaaactgcatgaaaatacaagtggaattcgtgacttagaacaggcagcggaacatattgcagcaaatgcactttatcaaatcgaggtaaatcatgtatctaaagtagtatttgacgctgaaatggtaaaaaatctgctgtcataaaaagaaaaatgaaacaattaaaaacaagaatgggtacatttgagattgatacatacaaagttccaaaagagtatcagtgctatggcatagagacaatttcgagaacaaatgacacacattggagtgtctgcacaatcagccagtctgtgaaggtgaatgacaaagtttatagtcctgttttatatcaaagctgtatgcatccagaacaggttacgatttatccacttaaagtagaacaggatggagagaagataacgtttgtcactcgttatgataaggcagaatataatctgaaagaaaaagagataaaagccgaattttgtatgtggtatccaaagctaaaaaagaaaagatgtaatccatgtcaaaattgtggaagatgttaaaaaaacggtcatttatgttagttaaatggccgtttttatggaaatggagagtataaaatgattacgctaaacgattatctatatgatggagatacgatttttcgcattttgcaaaaatatatcgatgatttaaaaaaaagtgcaaaagaaaatcaaaatgaaattgaccggattcacagtcattttttaattcagattcgtgaactccttgaacataatgatttcttgacggcacagtcccagaaaatccgtgaattttataaatatatggcaaaggaatatccatatcttgcttttacttttaagggaagaatcaaatctttgattcgggcggaggaaaaattcaacagttatgtgatggaatatatttatgaatattattccgaacatcaggtttatccgccagtctccgaattaaaaaagaaattaagctgttttcgagatttgattgcctatcgaattgtaatttctatgccgaaatgtcattttaaaagtgaacaggaaagaagagatgctgaattaaactgtttgtatgagattgcaaatgtactgccggaatttttagaggagcgtggatttacagcagagcctgcaaatggtgtgcaggaaagttgttcatctttattaaatccggaagtgaagccttattacagggattatgtatctaatcatgaagaaaatgagtatcagtctcttcacattacattttatgataatagttcacgaagttatatggaagtacagcttcggaccaagatgatggatgatgtggctgaaattggagcagcaaatcatcgtgtatatgaaaaaaagcaggaaaaagaacgaagaaaaagaaaccagattccgaaaggcgaatgtctgtattttgatgaggcatatgaacgagggatgcgtcttttggaactggatttatcaaaacttgatgtgaatatgttctcagcagttgataacaggttgattaatgatggatgtggattgtacagaggacgcttgattcttccttatgagcatttatcaagatttcaaaatgatttaattgactaaaaatgggaataaaaagaggataaattatgcagactgaaaaaagaaaaagttcagaaaaacaaaagataagaggtttcttatttgcattgtctgggggaattttatggggattttcaggaacatgtggacagtatctgtttacatttgaagatttaaattcggaatggctgacggtaacaagaatgttatttagcggaattattttgcttggtgtatctgccatcagtcatcgggaagaaatgactgcagtatggaaaaacaaaaaagatgcaataagacttgtcttatttgcaattttgggacttaccaattgtcaatatatgtatttgactgcaattgcttattcgaatgcgggaacggctactgtattgcagtatttaggtccggctttgattatgattatctcctgcgtgatgggaaggaggcttccctcgaaaaaagaactgggtgcaatcttgcttgcgattaccggaacatttctgcttgcaacacatggaaatccaggaacacttgtaatttcgaaagagggattattctggggactgagttccgcagtcgcactggtactttatacaatgctgccaggaaatttaattagtcgttatggaagtaccgtaattgttggttttggcatgatgataggtggtattttcttattttttgtatttggatattggaattataaaattgcttttcatttaccacttgttttaggtgtaggagcaattgttttgattgggaccgcacttgcatttacactgtatttacaaggtgtgagcgatatcggctcggtaaaggcaagtatgattgcatgtgtagagccagtatcagccaccattatttccgcattatggttaaagacaaaatttacaggaattgatatcgtggggcttatagcaattttaacagctgtattattattaagcaaaaaagataatagcagagtaaagactttgtcagttgaataagaaaataaaaaaattttgtttataggttatcggccggaacaaatctgatatactgtattttagaatacacgcacacgattagtttgaacttaccgacttgtttttgaaaatgatacaaaaaatcagacaaaaaacagaaaaaaatcagcaaaatacacaaaaaactcttgctctataaaaaataatacggtataatgaatataaataggggaataaaaaaatgtaatatcgtgaagatatataacctaataaaggaggaaacggaatgttagaccaatcatactatgaaaaggcggatgcgattattgaacagtatggtcgtaagcctgcctcactgattccgattatgcaggatattcaggcagaataccgttatttgccaggagagctgttaaattatgtggcagatgaaatcggagtcacccgttcaagagcgtacagcgtagcgactttttatgaaaacttttcttttgatgcaaaaggaaaatatatcattaaggtgtgtgatggtacagcctgtcatgttagaaaatctcagccggtaaaagatgcaattgtaaaagaactgggattagaggggaaaaaatgtacaacagatgacatgatgtttaccgtagagactgtatcttgtcttggcgcatgcggattagcaccaactatgatggtaaatgaagatgtccatccaaagatgacaccggataaggctgtaaaattaatcagagaattaagaggggggaatcaggaatgagtattgcaagcaaagaagacctgttgaacaagcaaaaagaagctcaggaaaagattgattcttacacctgtcgtattcttgtctgttcaggaaccggatgtgtggcttccggctcacagaaaatttatgatgaaatggtgaagctctgtgaaggattagataatgtagaagtcagcatgcagaaagacgtaccgcatattggtacagtaaaaacaggctgtcagggactttgcgaattaggaccgttagttcgtattgaaccacagcatttacagtatgtgcatgtccaggtggatgattgtaaagagattgtagaaaaaactgttttaaaaggcgagtcgattgaacggctgttttataaacatgaggaaaaaccatgtgaacatccggaagatattccgtttttgaatcagcagaccagaattgtactagagcattgtggaaatattgatgcggaatctattgatgaatacattgccgctggtggttttcaggcggttgtaaaggcattttttgagatgacaccggaagaagtcattgatgaaattacaaaatccggaatccgtggtcgaggcggtgccggtttcccaatgggtaaaaaatggagtcaggtggcacgaattgaatccgatgtaaaatatgttgtttgtaatggtgatgaaggtgaccctggagcatttatggatggctccgttatggaaggtgacccttataaattaatggaaggcatgattattgctgcttatgcggttggcgctcatgatggttatatttatgtgcgtgcggaatatccgctttctgttgcaaggttaaaactggcaatcgctcaggcagaagaatatggtcttttaggagataacatcttaggttcaggtgtgaacttccatttacatatcaaccgtggagcaggagcatttgtttgtggtgaaggttctgccctgacagcatcaattgagggtaaacgaggaatgcctcgtgtaaaaccacctcgtaccgtagaaaaaggtctttgggaaaaaccaaccgttttaaataatgttgaaacttatgcaaatgtagctagaatcattttagatggttcagactggtatcgttcaattggaacagaaggcagttcaggaacaaagacattttctttaaccggagcaattgaaaatacaggtctgattgaagttccgatgggaacaactcttcgtcagattatttatgatattggtggcggtattaaaaaaggagctgcatttaaggctgttcaaattggtggaccatctggtggatgtctggtagaaaaacatttggatgaaccgcttgattttgactctgttaagaagtttaatgcgattatcggttctggtggtctggttgttatggatgaaaatacctgcatggtagatgtggcaaaattctttatgggatttacacagagagaatcctgtggaaaatgcggtccatgtcgaatcggaacaaaacgtatgcttgaactgcttgagaaaattacaggtggtaaaggtgaaatgaaagacctggacaaactggaggaaacggcgaaatttattcagtctcgttccctttgtggacttggtaagagtgcaccgcttccggttatcagtacactgcaaaatttccgtgacgaatatgaagagcatatcgtagaaggaaaatgccgtgctcatgtttgtgaggtaatgaaagtttatacgattgaccctgaaaaatgtaagggatgtacaaaatgtgcacgtaattgtccggttagcgcaattacgggagaaaagaaagaaccgcatatcattgatcagattaaatgtattaaatgtggtacttgtatggaaaactgtgtatttgatgcaatcagtgtaagctaaaaaatcagtgtattgaaaaaaagaaaaggaggaggatgacatgattcatttgatgattgatggaaatcctgttgaagtggagaaaggcacaaccatccttcatgcagcgaaaaaggtaggaatcaagattcctacattatgttacatagaaaatttactgccggacggttcctgccgtttatgtgtagtggaagtaaaaaataacggaagaacaaaaattgatacggcttgtactttacaggcatcagagggcgatgaagtctttacgatgtctgaaaaagtaatccagtcaagaaaacagaccttagatttacttttatcagaccataacattcactgcttctcctgtgagggaaacggagattgtaagcttcaggattatgcttatgagtatggtttggattgttccagttatgaaggtgaaaaaagcggtggagaaatcgacgattccaataagttttttacttatgacccgagcctttgtattttatgtcacagatgtgtcaacacctgtaatgaaatcgtaggaagaggcgcaattgccacaatggaaagaggattccagtctattattggaaatggagaaggcaaatgggcagatggtacttgtgaatcctgtggtaactgtgttcaggcatgtccgacaggcgctcttaccatgaagcgcagaaagaaataccgtgcttatcaagtagaaaagaaagtgttgacgacttgtccacattgtgcaactggatgccagtattatctgttagtaaaagatggaaaaattgtggatacagaggcgtatgatggaccatctaataaaggtctgctctgcgtaaaagggcgaagcggaagctttgattttgtacaccatccatcaagaattactgacccattaattaaaaataaagaaaccggtgaatttgaaaaagcaacatgggatgaagcgcttgatctggttgcatccaaatttatggaaatcaaaaagaaatatggaacagaatctttagctggttttgcatgttcccgttcaccgaatgaagatatttacatggtacagaaaatggttcgtacctgttttggaaacaataataccgataactgtgcccgtgtatgtcactctgcttctgtagcaggtctggctatgacacttggttcaggtgcaatgaccaacccgattgaagatatcacaaagaaaccggatgtgattatgctggttggttcgaatccggaagaagcacatcctgttgttgggatgcagattcgtcaggcagttcagcgtggatgtaaattgattgtagtagacccgcgtgatatcggtcttgcaaaacatgcagatattcatctgaaattaaaacctggtacaaatgttgcatttgcaaatggtattatgaatgtcattatttctgagggacttcaggacgataaatttatcgctgagcgaaccgaaggctatgaaaaaatcaaagaaatcgtaaaagattatacaccggaacgagttgctcagatttgtcatattgatgcagaagatttaagaaaagcagcaattatgtatgcaaaagcaaagatggcaccaattatttattgtcttggtgtaaccgaacattcaaccggtacagaaggcgttatgtcgatgtcaaatatggctcttttagttggtaaattaggtcgtgaaggttgtggagtgaatccgcttcgtggtcagaataacgtacagggagcctgtgatatgggtgcttcgccgactgacttcccaggatatcagaaagtggcaaatccggatgttgttgcaaaatttgaaaaggcatggaataccaagttgaatccaaatccgggacttcatgcaacagatgtattcccggcagcaatcagaggagaaattaagggactgtatatttatggagaagaccctgttgtaacagacccggatacgcatcatattattaaagcactggaaagtctggacttctttgttattcaggaattatttatgacagagactgcggcttatgcagatgttattcttcctggtgtcagctatgcggaaaaagaaggaacatttaccaacacagaacgtcgtgtacagcgtgtgcgtaaagcagtaacaattcctggcaatgcaagattagataccgatattatcattgatttgatgaatcgtatgggttatcctcagccgcatctgacctcagcacagattatggatgaagtagcatctgtgacaccatcctttggaggaatcagtcatgcacgtcttgacagtgaagaagttgggggaaaagggcttcagtggccatgtctgacaaaagaccatccgggtactccgattatgcatgttggtaaatttgcaagaggtcttggctggttctatccggcagaatatattccgtcagcagaacttccggatgaagaatatccgattattctgatgactggacgtattttatatcactatacaacaagagcgatgaccggaaaaactccggaactgatggagattgaaggaaaatcctttattgaaatgaatgtggaagatgcagaagcacttggcattaagaatggagataaagttcgtctgacttccagacgtggtcagattgaatctacggctcgtgttggtacaaaagtatcaaaaggagagtcctggatgccattccacttcccggatggaaatgcaaactggctgacaaatgcggcgcttgataagtatgcaagaattccggaatataaagtatgtgcaattcgcattgaaaaagcgtagtacagcaaacttaagtttctgctgtagcagtagtagaactggttataaaatataaaaaaatgggggatattctcataagcggtaaagagaatatctcccgtttttgcatcaaatgattatttttatacaaaaacgtggtcaaggttgagctttttttgttactatgctacaataatttcaaaatcaaaataagagaaattttgaaaataaaaagataagaggaaaagatgatgaaatgtattaagacaacagaggcagtaggtcatgtactctgccatgatattacgcggattgtaaaagatgtggtaaaagatactgcattcagaaaaggacatattgtagaagagaaggatattccggtacttttatcgcttggaaaagataatttatatgtatgggaaaaagatgagaatactctgcatgaaaatgaagcagctcagattctctgtgacgtatgtatcaatgacaatatgcatccatccgatgtaaaagagggtaaaattgaattaattgcagactgtgatggagtatttcaggtagatgtaaagagactggatgctatcaatgagattgatgaaattatgattgcaaccaggcatacaaactttccggtaaaaaaaggagaccgtctgctgggaacaagagttattccgcttgtgattgcaaaagagaaaatggaacaggtgaaaaaaacagcaggggagactccgctggtttctttaactccatacaagaaaaagaccgttggaattgtgacaacaggaaatgaggtctactatggaagaattaaagatacatttacaccggttatcattgaaaaaatgaaagagtacaaaattgaagtatgtggtcatatcgtatgtaatgatgatatggaaaaaatcacaaaagcaattttagaattaaaggaaaaaggggcagagatgattgtctgtaccggaggaatgagtgtagatcctgatgataaaactccaggagcaatcaaggcaacaggagcaaggattgtttcttatggagcaccggtgcttccaggtgcaatgtttttactatcttacttaaaagatggaacaccggttatgggacttccggggtgtgtaatgtatgcaaaggcaacggtatttgatttggttttaccaagaattgtagcaggaattgaagtgacaaaaaaagatttggcacacatgggaaatggcggattttgcttaggatgtaaagaatgtcattatccaaactgcagttttggaaaaggtgtttaaaataatcaagtataaaaagatttcgagagcacattaagaaaaaagggggaaatgacatggaaaatctgacggtagaagaggcgcttgaacagttattatgtcatacaaaagaaatagaagaaacggaagaggtgtcgttgcttttggcaagaggaagaattcttgccaaagatgaaaaagcagagtttgataatccgccatttgaccgttctccggtagacggatatgcctgtcattttgaagatttaagtgaagcaaaaagtgatacaccagtgtgtttaaaagtaatagaggaaatagatgcaggtcaatattctgatcgggaagtaaaattgggagaggctgttcgtattatgacaggagcagccattccgacaggatgtgactgttgtgtaagacaggaagacactgattatggagaagatacggtaaagatttttaaaagtaaaaagaaatggcaagactattgctttcaaggagaggattttaagaaagataccgtattattaaaaaaaggtacaaaaatcggttttgttgaaactggaatccttgcgagtatgggcagagcaaaagttttagtaaaaagaaaagtaaaagctgctgttttaacgaccggagatgaagttatgactccggggcaacctttgcttccgggaaagatttataactcaaaccagagcctgctggtgactcgtctgttggattttgatgtagaactggtacgtattgatacgattcaggatgaaccacagaaaatggcagaggcaatcaaagaaatcgcaggacaggtagatttaatcgtaacaacaggagctgtatcggtaggcaagaaagatattatgcatgaggcacttcgtctgattggggcagagcgaattttctggagggtattaatgaaaccgggaatgccaactttgttttcagtatatcatgatgttccgattgtcagtctttctggaaatccatttggtgtggcggtcagcgtagatgtactgattcgaccaatgttacataaaatgacacaggatgaaacacttgcgattgtacataaaaaatgtgtattaaaaaatgaattcagtaagaaaatcaaagggagacgatatgtacgtgcttttgtagacgaaaccggagttatgattccatgtggacttcattccaatggagttcttgcgacaatggcaggatgtaactgtctgattgatatgcaggagggaaggccagggattcatgcaggagaagaggcagaagtgcttttgttgtagattcgatttgatttaaaatttgatttttggattttgacattaaaataagattacagaaaaaccggataaaagaaaaatgaaagcagaaagaacacagaaaaaacagtttatactggcagtaagcggagtaaaaaactcagggaagactacgttaattacaaaaatattgccctttttaaaggcgaaaggcttgaatgtggcagttattaaacatgatggacatgattttgaagcagatgttccggaaacagacagctggaagtttgcaaaggcaggtgcagatagcactcttatattttcaaagacgaaatatatgatgattcattatgacacggtactatcagaagaagaattcattgccagttttccgagcgcagatattattttgctggagggatttaaatattcaaagtactcaaaaatcgaactcatacgaaaaggcaactcggcaaaatctgtgtgtgacagtaaaaagctgttaggaattgtgacagattttaaaaaagaggaattaaaagaacaaaaaatattagaaacagagaaatgggagaaacagataaagatttttgatttaaatcaagcagggtctttggcagaatggatttatcaattatgggaagaaatccagaaaagataatctgaaaaaagtgaaaaggagcagtaaatcaaatggaagagcacaacagtatgacagaaaataaaagagagacaaaacttggggtaaaaacgaagcttgtcatcacaaaaacagaagatttttttggaccgggactgtttcatcttcttcagtttattgatgaaactggttcgattcatgcggcatcaaaaaagatgaaaatttcttattcaaaatgctggaaattgttaaatcgtgcggaagagcagatgggatttcagtttttaaatcgttacaatggtggtccacatggaggaacttcgatccttacagaagagggtagagaatttataaaacgatatgaggaaatgttggaagaagtaaaacagataagtcagaatgtatttgaaaaatattttgacagttatcagtaaaaatgacagggtgtcttttctttatttgaacgcagataaacattcccccactgacagatcgcaaagcgactgcgttcatgagcaagtagcgaagcggattgcgaatgtccgctttacagcaccctgtctatttaatcgaattaagaaagaccttcgattcaaaaatttttgtttgacaaagacttaagaaaatactttcatgcggtctcgccgtgcagcacaaattaaagttaaatgatattctttcgcaagttcaatcgcttctacagtaggagaagctttactggcaagaattggaatttgtgcataaatcgctttcattgccatgtcggttgggattcggccgcttgaataaacgatgcattcgcgtaaatcaatctgatttctaagtgcataaccgatcactttatcaagcgcattatgccggccgatatcttcacaggaaaataaaatctgaccgtttcttgcaagcaaacagctgtgagtggcgaaagttgtgctgtgaagcggcatgccgtcagcaaaggcatctgccatctgaaaaatccagtcgggtttccagttaatagaaggtacagtctttggagtttgtccggaaacaaaataatcatttaaaatatggtttccggtgcagcaggtaggagtgatttctataaaaaaattgttttcggtattttgcggaagtgttttcgatgttctgtttaaataaacctttgcccgttttccatattcgcagatataaatctgttcgatatcggagatggaatcaataattcgttccgttaaaagccgaccaagaactaattctgtcagatactgcgggagacaaacgagtttcatcgttaaatggtcatttaaatagacgtcaatcagatgctcttttaaaatttgttcctgttttgaaataagttgtccatcacggctgataaaccggtattcttttgtttctaataatggtaaatcgtggtattgttcgttaatatacataatttctccaatgcaaaaaagagttcttttattcatgttttctatgtgttatgataatagtataacagaaatgtctttgcttcaaaagagggaaaatataaaaaaagcagagaacaaaggaggatttattttagatgggaaaaataatagctgtcaatatcagtgagaagaaagggacacaaaaaaagaatgtgcatcgtgcaaaattaattgaagaatttggaattgaaaatgatgcacatgcgggaaaatggcatcgtcaggtcagccttctttcttacgaaaaaatagaggaatttaaagcaaaaggtgcgccgattgatgatggtgcatttggagagaacttaatcgtaagcggatatgatttaaaaagtcttccggttggaacaagatttcgctgtggagaggtgttgctggaagttactcagatcggaaaacaatgtcacagtggctgtgaaattttcaaaattatgggagattgtattatgccaagagaaggtatttttacaagagtgcttcatggaggaatcattgaagagggggatgagattcatatagaagaagaaacggatggagaaacagaaaagtaaattatgaaagataaatatggacgagaaattgattacttgagaatttcaattacagaccgatgtaatttgagatgtgtttattgtatgccggaagatggaatctgtcaggtttctcacaaagaaattttaacttatgatgagattcaaagaatctgttcctgtattacaacgcttggaataaaaaaataaaactgaccggcggagaaccgctcacaagaaaaaattgttcgaccctggtaagaatgttaaaagaacttccggagatcgaaaaagtaaccttgacaacgaatggaatgttattgaaagaacagatacaagaattggcagaggctgggattgataacattaatatcagtctggacactgtggataaagcaaagtttgagaaaattaccagaagaaaaggactttttaaagtgttggaaggattggaagaagctttaaaatatcccaatataggtctgaaaattaattgtgttccggtagttgaagaacctgaaaatctggtggcagttgccaagcttgcaaaagaatatccgatacatgtccggtttatagaaatgatgccgattggttatggaaaagaatttttatttcgaggagaaagtgaaatctgtgaaattttagaaaaagcttatggcagaatgactccaatttcaatgaggtatggaaatggaccctgccattactatgaaatttccggatttttaggaaaaattggatttatcagtgcaatgacccataaattctgtgaccagtgcaatcgtgtcagaatgacagcagagggatatttaaaagcctgtctgcagtaccagacaggaatcagtttaaaagatttaatccgaaatggatgtacggatgaagaattaacacaagcaatgaaaaaagtgatatgggaaaagccggttgggcatcattttacctcagggaacattgaagaagacgagatgaaactgatgtcacagataggtggctgaaggcgaaataaaaaggcgtgtttgtcggagaggagtaaaaatgagagcagcaattattacatccagtgattctggatatgcaaaagaaagagaagataaaagcggtccggtgattcgtgaaattttggaggcaaatggatatgaagttgttcatgccattttacttccggatgaaagagaaatgcttgcaaaagagatgaaaaaaattgcagacgaagcgattgcagaattgattgtaacgacaggtggaaccggattttcaaaaagagactgtatgccagaagcaacaaaagatattatagaaagggaagtaccgggaattccggaagcaatgcgtgcttacagtatgacaattacgccaagagccatgttaagccgtgccgcagcaggaatccgaaaaggtactttgattgtcaatcttccgggaagtccaaaagcggtaagagaaagtctggaatatattattccggctctggaacatggattacagattttaaccggggaggcttcaaactgtgccagaaaataaaaccgctttggtgattttagccggtggaaaaagcagtcgcatgggacgtgaaaaaagtgatttgattttgaatggaaatacttttttggagatacagatagaaaaaggaaaacagcttggaatcaaaaaaatttatatttccggttataagggagtgcgctgtacggaagaaattgtaatggatcgtatcaaaaaccgaggaccgctcggaggattggaagcctgctttagaaaagcatcagaagagggcttttcgcattgtctggtattaggtgtagatactccgcttgttccaaaagaagaattaaaaagtttagttgacaaggcacaaaaagaaagtgaaaacagagtggttctgcttcgacatgccgaaaaagaggaatctttgatgtcagtgtatgaaagtagtttatatcaggaaatagcacaatttctggaaacggggcaggcatctgtttttcgctttttaaatcaggttggttatgactgttatgatacacaggcagaagaatggtattttaccaatattaatgaaccggatgtgtatcaggaaatctgtaaaaaagagcagaaaatctgaattcggttagaagaaaggatttaactgaatcagataagtcgagatagtggttatttcttgtatgctgtactggaaatggtgaaatagaaaggatgataagatgattgatttacatttacacttagatggctctttgaatccgaaaaacatgttttggatggcagaaatgtcaggtgtgaaactatcgtttacagaagaaaacgaattaaaaaaacagatgatggtagagccggattgtaaaaatctcggagattatttagaaaaatttgatttaccgcttcaggtattacagacaaaagaatgtctggagtatgcagtctatgaattactaaaagaattacaagcgcagggactttgttatgcagaaatccgctttgcgccacaacttcaccaacaaagaaacttaacacaaaaagaagtggtagagtcggcagtcaaaggactcgaaaaagcaatgaaagaatttccgatagaagcacagctgattttatgttgtatgcgtggagagacgaatcatgctgagaatttagaaacagttaaaaccgcaaaagaatttttagaaaagggtgtctgtgcagttgatttggcaggaaatgagtcggcttatccgacaaaaatgtttgaagatgtatttttactggcaaaagaacaaaatgtgccgattattattcatgcaggagaggctgccggtgcagaaagtgtagaagaagcattagcgtgtggggctgtcagaattggtcatggaattcattcaatagaaagtccaaagcttttaaagcgattaaaagcagaaaaaatatatctggaattatgttattccagcaatcttcagacacaagctgtaaaaaattcctgtgagtatccgcttatagaatttttaaaaaaaggaattttagtgacgattaatactgataatatgacggtttcgaatacttcgttaaaaagagaatatcggttgttaaaagagacatttcagctttcggaggaaatgctacttcagcttgcagaaaacagcgtagaagcggcatttctgccacaaaaaaagaaactaaaattagagcagaaagtaaaacaggaatttttgaaatggctgagtacagagagaatttaatgaggtaggtgcgattaaaggaaaactgctggatgccgatgcccagtgggtaaaagtggaaacatcgaaaaaaggaacacagctgattaaccggaatatgattcgtaatattacttttgataagtagaatgaaaaatataaatcaggagtaaaaatttcaacgagcaggaaacagtaatgtcaatgttgcgtggattttggaaggagaagaacagttcgaatatatgtatcggctgttctttttttatttttaagcgttaattaaataggagaggtttttcttgtgtatagtagggcattagagtataataaaaccagattgtctgcatacgtttaaaagctaattcatttataaatacaaagaaagttcagaatggggattcgtaatgaaaaagaaaaaatggaataaaatactggctgtgcttttggcaatggtgacggcagtatcacttttgtcaggatgtggcggaaagagtgcggaaaaagaagataaagaaacaataacggtgtatttatggagcacaaacctgtatggaaaatatgcaccatacatccaggagcagcttccggatatcaatgttgaatttgtagtagggaataatgatctggatttctacaagttccttaaggaaaacggtggattgccggatattataacctgctgtcgcttttcactgcatgatgcaagtcctctgaaagatagtctgatggatctttccacaaccaatgtggcaggtgctgtctatgatacatacctcaggaattttatgaatgaggatggaagcgtaaactggcttccggtgtgtgcggatgcacatggttttgtagtcaacaaggatctttttgaaaagtatgatattcctctgccaactgattatgaaagctttgtttctgcctgtcaggtatttgaagagatgggaatccgtggttttgccgcagactattattatgattacacctgtatggaaacactgcagggtttgtcagcgtcagagttatcttctgcagacggacgcagatggcgtaccacctacggcgatccggatagtacaaagcgagaaggtctggacagtaccgtctggccggaggcttttgaacgtatggagcagtttattcaggataccgggttaagtcaggatgacctggacatgaattatgatgatatagttgagatgtaccaaagtggcaagcttgccatgtactttggcagttcttccggagtaaaaatgtttcaggatcagggcattaacacaacctttcttccgttctttcaggaaaacggtgaaaagtggctgatgacaaccccatatttccaggtggctttaaactgtgacctgacaaaggatgaaacacgccgaaagaaagcaatggaagtattgagcacaatgctttctgaggatgcacagaaccggatcattagtgagggacaggatctgttaagctacagtcaggatgtagatatgcagcttacggaatatctgaaagatgtgaaatctgtgatcgaagaaaatcatatgtatatccgcattgcgtcaaatgactttttttcgatttccaaggatgtagtttctaagatgctctcaggagaatatgatgcagagcaggcctatcagtcatttaattctcagcttcttgaggaaaaagccatttctgaaaatgtagtattgaattcacagaaatcttattccaaccgctttcatagcagtggaggcaatgcagcctattcggttatggcaaacacgctgcgtggcatttatgggacggatgtgctaatcgcaactggaaacagctttacgggaagcgtgctgaaagctggctatacagaaaaaatggcaggtgatatgatcatgccaaatggtctgttggcttacaatagtaagatgagtggagctgagctgaaagagacagttagaaattttgtagaaggctaccaggggggatttattccgtttaatcgtggttcccttcctgtggtcagcggcatttcagtggaagtcaaagaaacagctgatggttatacattgagtaaaattataaaggatggaaaaaaaattcaggacaatgatactttcacggtaacctgtctggcaataccacaacacatggaagcttatccggcagatggtaatattacatttaatggaggagatacctctgtgaaagatacttggacagaatatgtttcagagggtaatgccattcttgcagagtctgaagactatatgactctgaagtgagaaaattgaaaaagaaaagtagagggtatccattgctttaaacgcacaacacacaagccatctcatggtggctctcataagaaggggctcccttcagaatcgtgaagttcagagagttataaagaaaaatcaggctcaggaaaacatttttataacattttgtgcctaagcgaaaggaatggatataaaaaggaatggatataaaaatgaaagttaagaatcgtaatacaaaaagagagaaacgtgttataaaaaaacggttaaagatagctgtctttattgttctctttataggaatcatctcggctgttttccaatatttcaagtttgtgtccgcaactgtttatgaggaaagtgtttctcatctgacggaggtctttcatcagtctgataatatgttgagggaactgataaataaaaatctgacctatctccatatgtggggtgagaatcttcagaatacctccagtgaagatgaaatttgtgattatatagagaaagcacaggaagatgcaggttttttagaattctattttctatcaacaggtgggaattacaagatggtaacaggggaaacagggtatcttggattacaggaagatattgaagaagacatccggcagggaaatgatgtgataacaaatgcagcagtcccaggaaaatctcagctgcttgtttttgccactcccaaggctcatggaaactatcagggatttgaatatgatgcgattgccattgcttatgaaaactctgatatcgtagatgtgctggatatttctgctttcaatggaaatgcccagagttatattgttcatccggatggtcgtgttgtggtcgatcattcttctgagtcatgggggaacgtgtataatttctttggtattttgagagaacattcagatatgtccgaaaaagaaatcaatgaactttcggagaagtttaaagcaggatgtaccgatgcgatgatggtaaatctggatggaagaaactattatctggtctatgaaaaatcggatattcaggactggatatttctgggacttgtccaggcggatatcgtcaatgccagtatgaacagtctgcagcgtagtacgatacttcttgttagtacggttgtattctgtattgctgcatttcttatcagtctgattattcaaaaaggtagaataaatctcaggaaaaaagatacagagatcttgtacagggatgagctgttccaaaagctttcaatgaatgtggatgatgttttcctgatgctggatgcaaaaacatatcaggtagattatgtcagcccgaatgcggaaaaactgtttggtattacagtagaacagatctgcaaagacatttatgttctgaaaagactgcgtctggagaaatctgaagattcggagaaaaattatttggaagaaatccagattcatgaacagaaggaatgggagtttgaatgtgttcatcagaagacaggtgaaaaacgctggttccataatattgcaatgggaagtgagataaacggagaaaagaaatatatcctggtcatgtcggatcgtacctctgactggaaaatgaatcaggcactttctgaggcagtgcgtgcggcggagacggcaaacagggcaaagagtactttcctttccaatatgtctcatgatatccggacaccaatgaatgcgattatcggctttactacactggctgtaagtaatattgacgataaaaaaagagttcgggattatctgggtaagattctttcttccagtaatcatctgctctcactgatcaatgatatactggatatgagccgtattgagagtggaaagatccatctggaagagacagaggtcagtctgtcggatgtgcttcatgatctgaagacaattattagcggacagattcatgcaaagcagctggagctttatatggatgcaatggatgttacaaatgaggatgtctattgtgataagacgcgactcaaccaggtgttgctgaatcttttatccaatgcggttaagtttacaccggcaggcggaacggtttctgtccggctcaaacagtacccagggacagtaaaaggcagggaattgtacgagatccgggtaaaagataacggaatcggcatgagttcggaatttgtacagaagattttttccccttttgagagggagaggacttccacagtcagcagaacccagggtacagggcttggcatggctattaccaaaaatattgtggatatgatgggtggaacaattgaggtcaggacagagcagggcaaaggtacggaatttattgttcgtctgccatttcggattcagtctgagcacaaatacatagagaagatcgctgagttggagggtcttaaggcactggttgtagatgatgattttaatacctgtgacagtgtgacaaaaatgcttgtgagggttggaatgcgttcggaatggacactttctggtaaggaggctattctccgtgcacggcagtctatggaacttggggatgcattccatgcttatatcatcgactggcgtctgccagatatgaatggcattgaagttacacgccagatccgtagtcttggtgatgatacaccgattattattctgacggcttatgactggaccgatatcgaagaagaggccagagcggctggggtaactgctttctgcgcgaaaccaatgttcatgtcagatatcagagataccttgatgactgctatcggtcagaagcaggttgagcaggaggatactatttttcctgaagcaagttcggatttcagaggcagatgtatactgcttgtggaggataatgaattaaacagcgaaattgcggtggagatccttaatgagtatggttttctggttgaaactgccgaaaatggagctgaggcagtggagaaagttaagaattcgacgccaggtaattatgatctggtgttgatggatgtgcagatgcctgtaatgaatggatatgaggccactaagcaaatccgtgctctggatgatccgacactggcggaaattaccatccttgctatgaccgcaaatgcttttgatgaagataaaaagaaggcaatggaatgtggtatggatggcttcttatccaaaccaattgttatagaagagttgctccgtacattacagaagaatctgaatcaggtgcccggagtatcagaaaaatcacgcaaataaagaagtaagtgtaaatcagatgattggtattatgattggaagtatagctgtatttggaattatttattattttgttacattgttgccagaaggtgaaggcggacgataagcaacattatttttagaagatgaaaagccaaaacagaatttctgaataatatgtcccatgatatccgtacgccaatgaatgtgatactgggatataattagctgatgaaagcacaactgacagaaccgaagcagcttgattatcagaagagaatcgaataatccgggaaactgttataaattagggaggtgctacaatgccatttaagatagtccgcaacgatataacaaaagtaaaagcagatgtgattgtaaatactgctaatccaaatccgatatgtgcaagtggcacggacttagcaatatatgaagcagcaggaaaagaaaaacttctcgtagaaagagcaggtatcggcaaaattgcaaggggtgatattgctgttaccggtgcatataacttaaaggcaaaatatattattcatacagtaggaccggtatggacagatggaaagcatcatgaatttgaaatccttgagaattgttatcgaaaatcattacagaaagcattggaacttgagtgtgagagtatagcatttccactgatttcgacaggagcatatggatttccgaaggataaggcattacagattgctgtgtcagtattcagccagtgtcttaccgaaaatgagatagaaatcatacaggtagtatttgataaaagatcttttcaactttctggtcagattgttgggaatattgattcttatatagatgcaaattacgtcagagaaatccatagaaaagagtatccgataaggagcagaagaagtactcgtataaaagaattggcagaagaagattttaatgaggaaatgcttcaaagagaagaagacaactatccacttgagaaaatgacagatacgggcatgacagagttgctcatgccgttagaaagtatatcattagaagaccagctggcaaatataggagcttcctttcatgataaattatttgagctgatcgacgaagcacatcttgataataaggatgtgtggaaacgggcaaatcttaatagaaaacatttttcaaagattcagtgtgaccagaactatcatccaaagaaaaagacggtaatggcactctgtattgcacttcagcttgatctggaacagtcaaaagacttacttgccagagcagactgggcattcagcccaaacagtaaggtggatttgattgtacaaaaggcaataatagataagcagtatgatattatgcagctgaatatgactttgtttaagtatacgaatgaaattcttggagtataggagcaagatggatatgtggaatgagtggaatgacatattttctattcaagaaaaagccagctacaaagacatatgataaagaaaataagaaaccagtaatcaaagcgagcatatgtaatggcgagcaggtagctgggtttaaagatatttatacaggtaaaatagaggagattatgctgattaagaaccaggcagaccttgatgcattcaagaaaatgtatggaatagatggcgagatagaaaaggaatattaaacaatgtatttgattaaaatatcctcattgtaagacaagaacttggtgcaagaaagtcatgaccaaagagtgataatcaaatcatatagacagggtatgtcaacagcaggttgcttttcagaacatgaatttatctgtatgatatggttatggaggtgacgacgatggaaacaaaaaatattattttgaaacttcgtactgaaagaggaatgtcacaagacgaactggcagataaaatcatggtcacaaggcaggcagtatcacgttgggaaaatggagatacagttccaaatactgataccctcaagctcttatcgaaagaatttgatgtttcaatcaatacgcttttgggagaacccagaaagctgatttgccagtgttgcgggatgccaattgatgaggattccatattgggacgtgataaggatggcacattaaatgaggagtattgtaaatggtgctatgcagatggaacgtacacatataacgatatggatgaattgattgatgtatgtgtaaagaatatggtaaatgaaagctttaccgaagaacaggcacgcacttatctgaaagaaatgcttccaaagttagattactggaaaagatatgatgagcttagtgacaatgggcagtttgaagagtttaaaaagcaattgataaatgaaattaatgatctgcatatagacggacttccaagggtagacaaactaaatgcacttgtggggaaatatgtgaatctggattatactctgcctaatggtcaaaaagtgaaattccttgatgatcagaaaacctatctggggaaccaactggagtctgaatttggaggagacaggtgcttcggtattctggcaggtatggattttattctggtatgtacatatgagaaggatggtgaaaatccagagttgttgatttataaaaagagataatataagcaaaaagaaaagtcttgagtagtgtattatgaataaatacttaaactactggggagtgatttttgcggctatctttgctccgtgtcatatcctaataagctatatgaatgcggttttatcatgatttgaagatcgataacttatggcagatatgaaggtaaaaatagatgaagtgttcaaacaaaaggagaaaatatggaatcagatataattaaaatcagccatctgaataaaagctttggcgaagtaaaggcagtaaatgatctgagctttcgtgtgaaaaaaggagaattgtttgcgtttcttggagtaaacggtgcagggaaaagtacaaccatttctattctctgtggattgctgaaaaaagacagtggaactgttcagataaacggaatagaaactgacaaagccggtgcacagacaaaaaggatgattggtgttgtatttcaggatagcgtacttgataaaccgcttacggtgaaagaaaacctaaagagcagagctgctttatacggcattacaggaaatgcctttgataagagattacaggagctggtcgagattctggattttgacgagtttttaaacagacctgtaggtaagctgtcaggaggtcagagaagaagaattgatattgcccgtgcattattgcacagaccggagattttgattcttgacgagcctactacagggcttgatccgcagacaaggcagttaatctggaatgttatcgagaagcttcagaaaacagaaaatatgacagtatttctgactacacattatatggaagaggctgctaatgccgggtatgttgtaattcttgacaaaggaagtattgcagcggaaggtacaccgtttgaacttaaaaatgattatgtacaggatatcgtatctgtttatggtgtttccgaagatgaaataaagtcattgaacagagaatataaaaaaatacgtgatggatatcagataaaagtaagaaatacgaaggaagcaatgaagcttattgtagagcatcaggacctattcacggattatgaagtagtaaaaggcggtatggatgatgtatttcttgcagtcacaggaaaaaggcttggaggtgagcattgatgagaacagtattggcattaatgaacaggaacaggaaactgttttttaaagataaaggtatgctgtttacgtcaatgatcacacccgtcattctgattgttctgtacgctacgtttcttgcaaaggttttcagagattcttttacagcggcgattccggatatgatcacgatttcggataagctcatcaatggaaccgtggcggcacagctgacagcatcacttatggcagtaagctgtattactgtaacattttgtgtaaatctgactatggtgcaggacaaggcaaatggaacaaggaaggattttaatgtttcaccggtcagcagggaaaaaatttatttgggatatttcctttcaacagttgctaattctttgatggtcaatggacttgcgtttgtattatgcctgggatatttatttaaaatgggatggtatatgaatgcagcagacgtaatatgggttttatttgatatgatattgctcgtcctgtttggaagtacgctttcaagtatcattagctttccattgacaacacagggacagctttcggctgtgggtacaattgtcagcgcaggttatggttttatatgtggagcttatatgccaatttcaaattttggttcaggtcttcagaaggcactgtcttatcttccgagcacatatgccacttcattgattaagaatcatatgcttcacggagtgttcagggagatggagagaaaacattatccggatgaaatggttgaagcgataagagacactcttgattgcaatccggtatttcatggaaatgtggtaagtgtaaatcagatgattggcattatgatgggaagtatagctgtatttggaattatttattattttgttacattgctgccagaaggtgaaggcagacgataggaaatattattttcagtgagtgaaattcctttgttttgtccaaaatgcaaagaagaaagcctgattaatgcagaaaaatttatagtaaaggaagccagacgctaagacgcagtgcagattgtaatattacagttttgcactgtgtcgtttatattatggaggtcaaataagaatgaaagcaatcatatatacatcaaataccggaagtacagcagagtatgcaaaattactgggaaagggattgaatcttccggtacataaagtacgtcgttatattctgaatagaatgaatacgacaaaaaagtgcaggaatataaagatatggaattaagattattacgttattttttaacagtagcaaaagaacagagctttacaaaagcagcagaacaattgcatattacccagccaacgctttccagacaaatggcggcatttgaagaggacctgggaataatattatttattcgaaacgggaagaaaatatcgctcactgatgaaggaattttattaaaaaggcgtgccttggagatccttaatcttgaggaaaggacgctggaggaactgaaaggaaaagaagaggttgtagagggcacgataaccattggatgcggtgaatttgcggcagtggagacattggcgaagatatgtaaaacgtataaagaaaaatatccgctggttcagattgtattgcatactgcaacagcagatgtagtgtatgagatgatgaacaaaggacttgtagatattgcattattcatggagccggtggacaccgaagggctggattatatccggatcacagattgcgatcactggtgtgtcggaatgcggccggatgatccgctggcagaaaaagagtttataaaaaaagaagatcttattggaaagcccttgatcctgccagaaagaatgaacgttcaaagtgaacttgccaactggtttgggaaagacttttcaaaattacagattgcttttacgagtaatcttggaacgaatgccggagttatggcggcaaatggactggggtatccaatttcaattgagggtgctgcaaagtattggcgagaggatattcttgtacagcgaagaatttctcctgaaatcacgaccagtacggtgattgcctggcgacggaatatcccatattctttggcagtccgtaaaatgattgaggagattaatgcttttcaggcataaaacaaaattcaatataagcattagacataatgaagcgatagagcttaaaatagatgtgtaagatgaatgtaaatcttatacatctatttttttgtgaaaaatacgtatagaaaggggctttttattatgagtaaaaaattagtggcatttttcagtgcaagcggaacaacaaaaaaagtagcagagatgatcgcagaggaagtaaaagcggatttgtttgagattgagccgaaagttccatatacaaagcctgatcttgactggatgaataaaaaatccagaagcagtgtggaaatgagtgataaaaaatatagaccggcgattatgaaaaaagagatggatatgagttcttatgacgagatccttctgggattccctaaaatggagtacagtttatagtagtgtatagcgtgtaccaagttataattatggggttgaaaataacagtatacacagataatgtggaaaaatgtgtatgacgtttatatagaaaataacattgaaaaagaaattcaagaatgggtaaattcattaaatttaaaatagaataataattacatgagtgacagaagataagaatctgaattccctgtcacttttatattatttgataagaaaaaagaactggtttatatccgataagaatatagactggttcttatttttaatatgctattatatacacagggagtcggggaatgtcgaactatagcaagccggaaaagaaagcattgatatcggtatgaaagagttttgcaagtgcaactaattcagatgccttaatgttcatgcgatttgtttccagtttggcataggtacttttagtgatggagatacccataagatttaattttgcaactacttggtcttgagtcatattgtttttataacgaattgcttggatatttttaccaatatccatatctggtctaatcttttgcataataatgaactccccttataaaataaaaagtttcgcaataaagaaatatatatattgattctaaagagtttaaaatttataatgtttcgtaataaggaattatttttaacaagaagaggtaaaagtatgatggatgtggagcaggaaaaaagaaaatttttaaatctatgtggcaaaagagatcgagcattattgtcaggtgaaaaaaggatgacattgggggatatggaacgattgacatatctgacagaattttttgaactggagaactacggaatcgccttatggaaagaatttggtgatgatgtaaaagagccatttgaagcgatgatgaaaatgttagatgagccggagtgcatagaagatcgatggcttgatgacgaagcaaaaggagaaaagtggttgttagaatttcaggaattagcattaacggaagaatacagggaatggattcgagattatatcgataaaaaatatgaagaaaaaggattaccatatccgacaggagcagacttcgattaaggggtctgtttttttctggtcttttgggaggtgataagaggtggaagtaagtatttatgaactgttggcggcagcgagagaatcggctaaatctgattatataaaaggggacagcattttatgtgcgaaaagattttatccagattcccattacatggtagaaatagagttattagaaaatgataacaagctgggagaaaaggggaattacatacggaagtttctgacagaaccggagtatcttcccattttacaaaagcaggaaaaacatctcataaaaataaaaagacaggcgattgttcaaaaaggaaacttgcgatatatccctcccctggacaggctggaccgccgccgggagagggatattttataaccggctgggaaggaacagtagtgttcctctggcgatagtggtataaaaaagccagattttccgcaggttttgggacgctggaacatggaaaagtgttcacgaatggcacttttgcaacaatccgttgcagcagtgaaagcatttttgaccttacgttaaacagaaaaatgaaagggtgtgattgtgataatcataggaattgatcatggctattatgcaataaaaacaagacaagtgtctttcccaagtggaattatcaggtatgattacgagccgtataccatgcagaatgttctgcagtatcagggaaagtattatgtctgtggtacagggagacagacactggtaaaaaataaaacgtccaatgataattattatctgctgacgttggcagccattgcagaagaaatcaagcatcggaaagcggaacgaaagacagaggtaattctggctgttggacttccgctttcaagttttggaagagagaaacagggattcagggagtatctgttgcggaaagagcagccagtgcgatttttatatgaaagtgaattatatgagataacaataaaagatgtgaaactgttcccacagggatactctgcgcttgctctgcatccagagtatctgaagaatgaaccgtctgttctgcttgttgatattggtggctggaccgttgaccttatgaggctggacaatgctgttccgaatgcagcaacgtgcaggagtctggagcttggagtgatccgatgtattgatgagacagcagaacaggtgcgtagaaataccggactgtctgtaacagaaactcaaattgagcgtgtgcttcggggagaatcttgcagtatggcagaagaggccagacggatcatacaggaaaacggacggaaatatatagaaagaatactgtctgcggtgacagaatccgggtttgatctccgggcagtaccaaccgtatttatgggtggaggctccacaattttaaaacgccacgtgaccgcacaggacgcgatttgccgccttgtttttatagaggacgtccatgccaacgcaacagggtatgaacggattgtagagcagatgtgggcgagatgacacgccctgtgtattcgttccgcccgaacctgaaaaatccagaacaccagagagcatgggagaaatttcaaagtgttccagaagggcagaaaagccagtatctggttcaggcaattctggaaaaagaggatcgaaaatggctggaagaagtcattcaaaagacgataaaagaaagtgttcaggaattaggaatatgtggcactacggaacaatcgacaacgaaactatcatcggaagaaataccagatcagatgatggattttctatctcaaatggaaaatttgtaaagggggtgaggcctatgattgcacgatacatacattgttggatctgctaggggcaaggcaagaaatgcatcgttatctttggtgggtattgtgaatagctttccatgcggctttggagtatgttgtgtgtagcgaaagagaaaggagaaaggttatggcagagatgaaaaatatctgcggaaagatcccgatggacttacatgagaaagtaagagaagagattgaactcacagaaagcagcacacaaaaatttttacaacaggtcattgaagaacatttcaacagactggaaggaaaaggagaaataagcatgggagcagtaagaacagtagcagtacaggtatcagaggaattattccagagattaaaagtagtcatcggaaagaaacacatgaaacagaaagacttcttaattcagattatagaagaagcactggaaaaggcagaggccgaatggcaaagcaaagatcagcctgaagaatccgaacagacaactggagaattgggaacagaagaaactcaaccggaagaaagcactgagccggaaagggaaagcgaaccagatggagagagcgaaccgaaagaggaaaacgaatcagaagaggagagcgaaccgaaagaggaaaacgaaccagaaggggaaagcgaaccggaagaggaaactgaaccagaaagtgaaactgatctggaagaagaaaccaaagcagaagaaccaacagaatggtaaccaattgatacagaataacgaagggcggtatgagagatcatgccgcctgtttttatcagcaaaaaggaggttgatagccgcaaccattcaattttttgatctctttagcggaatcgggggattccgtgaaggcttaagacgggcaggaaactttgtctgtgtcggacattgtgaggtggatacttatgcggataagaactaccgattgctgtttgatacggaaggggagtggtattgtaatgacgcaagaacaatcgaaccagaacgaatgccagattttgatttactctgtgcaggatttccttgccaggcattctctatcgccggaaagcgagaaggatttgccgatgcaagaggaactctcttttttgaaattgcccggattcttgaagctaaaagaccctcgtattttatccttgaaaatgttcccggtttgttatcgcatgacaaaggccggacgttttgcaccatcctcagtacgctttctgaactggggtaccatgtcgaatggaaagtgcttaacagcaaggatttcggagtcccccaagcaagaaaacgggtgtatattgtcggatatcttgatttccgatgtgccggaaaagtattacctgaaccagaaacaaatggagcagctcttgttcaaatccgggcaggaagtcagggaaaaagagtttacagtccaaaaggattaagctgtaccctgacatcacaggccggaggaatgggtggaaagacaggattatatgatgtgggtgttccaattaaagaaaatacaaagctcggctacaaacttgcaagagagggtgacagcatcgatttaggctatgcgaatctcaacagcaggagaggaagagttggacatcagatagcacacaccttgactacaggtattcaacagggaacacttcattttgtagatttgtctccgccgccactggtaactgaagaatgcagaagccttaatacccgacaatgcggaatccataaatacaaaggagaatgttccggtgtattaagggaagaaggggcaagagcagtccttacaccagccaaggaaaatgtccgtcagaatggcagacgtatgaaaaatccagaagaaccgatgttcacaattactgcaaccgatcgtcatggcatcttgtatcacggaagaataagaagattagttccaagggagtgtctgcgtctgcaggggtattatgattggcaaataaataaaatcatagacagcacttctgatgcacagctttataaacaggctggaaacggggtaactgtcaatgtcatcgaggcaattggcaaactattacaaaaggcagactccgaactcaacgaacaggaagtgtctgagaaaggaatccattaggcatgatcggtataaaagaccaatactttggcacagaaatcgaaatgacagggattaccagacaacgtgctgcagaagttgttgctgaaatgtttggaacagaagcatattatgacggcacgacctacggaatctggtcagtgatagatttggaaggaaaaaagtggaaatttatgtctgatggaagcatttatacacaacggaaagtatacggtcgaattgtagacgcaggcggagaatattcaacagaaatggtatctccgaaattatcctatgatgaaatgggtaagttacaggaagtagtacgctgtctgcgacggaatggaggttttgtaaatgagtcctgtggtcagcatgttcatgtagatgcatcgaatcatacaccgcaaagcctgaaaaatgcactgacaattatgtatgcaaaggaagatatcctgttcaaagcattaaaagtgcaggaaagaagagcaaatagttattgccagagggtgcgaccggatgtattagagaaaatccgaaaaataccaaatagatcaatcactatggaccgagtaagaaatgtctggtatggaggtagggatggaagtcatacccattatgatcatacccgttattatgctctaaatcttcatgctgtgttttccaagggaactttggaatggcgctgttttgaaagcacactacatgcagggaaggtaagagcaaacattacactggcattagccatttccgcacaggcaatcaatcagagatctacacagatgaaaaagacactgatatcagaaaatccggcatttacatttcgtacatttttattgagacttgggttaattggagatgaatataaaaatgtccgaaaacatctgctggcaaatctggatggtgatcttgcgtggagatatgataaaagcacgtatgagtgtctgaagaaaaatcaaaggacagaaggagtcagatagaggtgagaaaaatagaagagagatattacttcgcttatggcagtaacatgaatctggagcagatgaagtacaggtgtccggctgcggaagttgtggaaaatgtccggctggaagattatcggctggcatttcgaggaagggctccgggtaacggagtagcaacggtactgccggaaaaaggaagctgtgtcgaaggagtcttatggaaaatcacagaagcgtgtgagaagagtctggatttttatgaaggatttccaagtttttatgggaaagaatcaattcgtgtaaaaaatcgggatggtgtggagaaagaagtgtttgtatatatgatgaacgctccgcacaaagatgttccggcaaagccatcgaaattttatctggatggaattctggaaggatgtaaggataaccagattccaacggagtctgtcatggaagcggtaaaacgtaccagacaggaagtaaaaaaagaaaaaaatcgatatgcaagataaaacgtaccgcagaggaaacatcttctgcggtatttaatttaaaaaatctatttataataggaaggaaaagcacatgaaggttagaaaattaaagaccagaattgctgcttttggactggctgtcctgatgggcatcagtaccttgagcagtgcgaatgcgtttgcggccgaacagacaggctcggaacagcagacggaagtacaggcggtaacaagccagaaagatacatcggttacagcagatgatattacaaaagcggtttcggatgaaacattcgcagtggaaaccagtatggaaggaatccattatgatgcagaaaaagaagatgttacgcttgtaagtatcaaagatgagaatggtggagagtatcattctgacaaatcaggaacatatattgccacttatatggtcgttccaaaagataagagtgacagctataccatcacccggaaagtgactctgacggatacagaaggtcaggcacattccgaagaaaatggtggagagaaacagaagtcagatacagaatctgaagatgattcggattcgcctgtgcagaactacacagatgtagaaattgaaacatccgaagaagatgcatctgcacaggcagtcaaagaactgaaagaggacatcgaagagggaaatgtgatggtattgtctgcggctgaaagagctacaagcagcggttctacagttacattgacaaaggggagaactatttattatccaagctatattggaaattatcttacttgcctgtttacagtcaatggaaagattgcatactgccttcagtcccagaaagcatccccaccgagtggaagttatgtagcacaggtactggacagcaataaaaatctgcagaaagttctttattatggttatggtggggcaggagatctgacagggagttatctgtttggaaaaacggaagatgaaaagtatgtgtatacacacattgcagccagctacgcttatgcaggagaagccggatttacaggatgtaattataatgaccttgtaaatgcaggggttattgcatatatcaattatctgttcggacaggaagaaccgccaaaaggtgaactgagcttttcaagcacaaagctgaatgcagtacgggatggaaatatccagaaaacaccaaatatcacattgtctggagatcacagaaactatgtgacactgagtgtaccggaaaatgtgacagcacataatctttccaaaggaacaagtgttacaaagggaaaaatccagatttatggtggagatacattctatctgtctgcggatttattactgacaggcagttatgcttccggcaacttatatggttctgtcggaaagacatggagaacactggtgctgacaaccggaaattccaagcaggatatcggtgtatttgaaagtgaaacagcagctccggtaagttttagtgtacagtggctgaatatgacacgcattgaacttatgaagaaagatgtcaatacacagaatccactgtctggagcagtttatggtatttataccgataagaagtgtgaaaacctgcttataacaatgtcagcaaccggaacagatggaaaagcagtcagcgattattttgattcagcactgaaaactgtgtatgtaaaagaagttactgacccgacagggtacaaactgaatacagaagtatataaagtggatgttgcagccggaaagacattgtctgtaactgcaaccgatgagagagtcacaggaaaagtaaaaatcgcaaagatcgataaagaaacacttgcatttaaagcacagggtgacagtgctcttcgtggtgcagtctatggtctgtatgcaaaagaggacatcgtgcatccggatggtacaacaggagttctgtataaacaggacagcctgattgcacagggagtcatcggagatgacggaacactggaattttcagaattataccttggagaaatgtatgtaaaagaaatcactccaccggaaggatatacgctggatactacaaaatatgaggtatcagtaacttatgaaggtcaggatgttgcggaagtgacaagagaccttacggtaaaagagcaggtaaagaaacaggcattccagttgatcaaaatcagtgaagatggagagcagacagaaacagacctggttgcaggagcaggatttaaggtatatctgatcagcgacctgacacaggtaaaaaatgggaaactgaaacctgccaatggagaaagctatacagcaaacgatttcaaaaattatgacttcagcaaagagcaggttgcagttacttatgagaacggaacagccgtaccagtaccggaactaattactgatacaaaaggatatgcagtcagcccggaactgccgtatggaagttatgttgtagtggaaagcactacccctgagaatctgaaaaccattgatccatttgttgtaaatgtggaaaatgacagcagagagccaatgcagtggagagtatttgatgaccgcccgtttgaatttttgctgaaaatcgtaaagaaggatgcacagactggaaataccgttttaaaggctggagcatcttataagatttacgatgtaacaaataagaaatatgtggaacaggttgttcagtatccgaagaaagaaaagatcagtgtattcaaaacaaatgaggaaggatatctgatcacaccgcaggaactgaagtgctctacctaccgaatcgaagaagtgaaagcaccggaaggatttgtaagacagggaagcgaagagtccctgtatgatggaacaacgattatttcaccattagagcagactacaaaaggaacatataaagaaaatccacagagtggtattgtaattacagtatcctcaaacactgcacatcagattgatccggatacaggagctgcgattgtagaggtagaacagaaaaatgacgaacaggtaggaagcctgcttctgacgaaaaagggagaacagcttaccgaagtaaccggagattctgttctggcaaaagtaaaagcactggtttctaaagtaagaaatgccgtatctggtaaagaagaaacaggtatttataaaggctttaaatatgaagaaaccggagtagaaggtgctgaattcgaagtatatgccaaagataccatttattcaccggacggagcaaaggacgaagaaggaaatccagttgtccgttatgagaaagatgacctggtagccagactgactacagatgaaaatggaacagcagttatcaacaatctgccactgggaatgtattatctgaaagaagttgtagcaggagagaattttgtcctgaatacagaacagaaagaatttaccctgacagcagaggatgatacacaggcagttgtttatgaaggcgttacctataaaaatgaaagacagaaagtttccgtatcagtagaaaagaaagattctgtcacaggcgaaaagctggaaggtgttatttttggactgtatgctgcagaagatattctttctaatcagggagaggttctcgtagagaaagataccctgctggaaaagaaagcaacggatgcaaagggaacacttactttcgacagtgatcttccacatggaaaatactatgtcaaagaggaagtcagaaaagccggatatcttccaaatgaggaagtatggaatgtagatgcaacttacgaaaatcagaatcttgcaaagattgaactgaacaaagaagttgagaatcagccgacagaaacacgcattacaaaaacagatgcaacaacaggaaatgagctggaaggagcaaaactgcaggtcattgataaagacggaactgttgtggaagagtgggtcagtacgaaggaagaacatgtcatttacggactgccggaaggaagttatactttacatgaggaactggctccttatgaagatggctatgtgtccgccagcgatgtgacgtttgaagtcaaagaagatggcagtgtgacaaaggttgagatgaaagatgaatattccaaagtggaaatttcaaaaacagaccttacaaccggaaaagaactggaaggggcaaagcttcagattatccgcaaagacggaactgttctggaagagtggattacggacggaaaaccacattccgttgaaaagctcccagtcaatgaagaacttactctgcgtgaaatcacagcaccggatggttacgagattgcggaagatgttacattcacattgaaagatacaatggaagtccagaaagtagaaatgaaagatgccagaacaccggagaaaacaacagaaaaaacaaatgcaccaaaaacaggtgacaaccagaaagtatgggcatttgttctgcttgcattgacatctgccggaacagctacgggagtgactgtataccgcagaaagaagtcaaaaatgacagacaacaaagaagaaacagaagaaaaataaaataagaattacaggataaaccaatttgacagggcaggagatgtgcataaggcagcttctgccctgtttgtagataaggagaagaatgatgagacgtttttatacagcagaatcagtaacagaaggacacccggacaaagtatgcgatcagatagcagatgcaatcttagatgaatgtctgcgttatgatccatcttcgagagtggcgtgtgaagtccttgccacaagaggaaatgtgtttgtagcaggagaaatcagcagcggatatgagccgccagtgtttgatgtaatccgaaaagttttagaagagtgtggatattgtacagatgggatagaaatggatacgtttgtacaccagcagagtccagatattgcgaaagcagtgagtgtgtcgaaagaatttcgggataatatcggcgcaaaaataagagacaggagcaggggagctggagatcagggtgttatggtcggatatgcgtgcgatgagactccgcagcttatgccaatgccgactgttctggcacaccggatcacacgtgaactttcagcttgcagaagaagcggatatatcaaagatatcttttctgatggaaaagcacaggtaaccgtagaatatgaagatggaaagccagtgagactggaaagtgttgttgtttcctgccagcatggtacagaaaagagtctgaaaaagttagatgccgagatcagagagaaggtgcttcgcccggcactcagattactgcctccggatgaggatacgaaaattctgattaatccgtcagggagatttgtgtgcggagggtttgatgcagataccggactgaccggaagaaagctgatggtggatacttatggcagtatggttccgcatggtggcggtgcattttcaggaaaagactgttcgaaagtagaccgttcggcggcttatatggcaaggtatatcgccaaaaatatagtggctgctgagtttgcaagcaagtgtcaggtgtctttggcttatgcaatcggagtagcagagccggttatgattgaggtagacacctttggtacaggaaaagtgtgtgcggatgattgtctggcggcagcaatcccactggtgtttggagtgacacccgttcagatcatggaatcccttcgactgaatcgtccgattttccgtcagacggcagtttttggtcattttggaagaaaggagtttccttgggagcggacggataaggtactggctcttcaggatgcaattctgtaatgccttgggtaacggaagaagagattcaggcagcaaaaaatatgactgcgtatgagtatttgcgaacgcatcaggcacagcggctgcaaaagacaaggaccagaaatgaatggcagttgacggatcatgacagttttaaaatcaatgaactgtccggcaaatggcattggaaatccagagatatcggtggcgtgtccgcactgcgcttcctgattgaagtagatggaatgaaatttacagatgccgtaaaactgttgtgcgaagagagtccgtcttttattccgacacaggctgtggaaagggaaaaactgccatttaagttgccggagaggtattgtaattgcagacgaatcagggcttatttaaaccacagaggaatcagcgatgaagtgatcacatattgtatttcacatgaaatcctttatgaaagtgtcccgtaccataacgctgtttttgttgggaaagatgaatccagaaaagcaagatatgcattcctgcgaggaatctatgaaaaaaacgggaagggattcaagatggagcagaccgggagtgaaaaaaagtacagcttttgcattccacctgaaagagaaacaaagcgagttgccgtatatgaagcgtgtattgatgcattggcacacatgacactggaagagggaaatagggataaatatcgtctttcccttgggggaatcgctgctccgaaagaaaacgcacagatacagagtgaacgttttaaaaagccaccggacgcactggaagagtttctgaagaaccattcggaaatcaaagaaattgaaatctgtaccgataatgactttgcaggaagatgggcgaaagaacagatgaaaaaacattatgagggaacgtatcagattatctgcaatctgccgaaaaaagaaggagcagattatgcagaccttgcgaaagaaaaaaagcaggcaaataaatgcagggacagaccattagaaagaaggtgatagagaatggaagaaaaaggaacgatacacgtacatctgttgacggagctgactggaaatctttattcagaagaatccgaatgggaagaagattggtcggagagtgatgaatatggaatgccgttagatggaacagaacttgccgattatgaagatgccatccgagaagaactggaacgctatggggaagatgatctcatgcagtattttgatggaagtgagtccattcatggaaaaatacaaagtgcagttgttacgatagaaaacaaagatggaatcctgtacggctgtaccaaactggaattaaatgaatttttaagtcaggaagaactacaggaattcaccgaatacattacagggcagtacagtgacggttggggtgaaggatttgagcagagggatatcaaggtagatggtggaatgctgaatgtgcatttctggcatcctgatatggagcagccgaaaatctatgaaaagaaaacagagcagatcccgataaagcctgagaaacaacgtcccaagttacaactccttggacatgatgggaatattttttccattatgggcgatgcctcaactcttttgaaaaagaataaacagacagcagaagcaaaagaaatgtgtaaaagggtattggaaagtggggattattacaaagcacttttgattatcagcgaatatgtggaaaccgagttgagtccaccaccaaaagaaaataaaaagacaaagaagaaaaatcagccggaacgctgagaaaagaaaggatgatgcctatgacaaatggcctgagtttggaagaacttatgaaagaggaaacatacccggaggaatatgctgaaggggaaaactggaaaatattacatggagatacattaaaactggtcaaagcattccagccgggaatctttgatgcagtcattaccgatccaccgtatgcgtccggtggaacaaagcagaatgaaagaaatcgtactacaaaccagaaatacagcagtatgagtgctgcaaatgcacttccggatttcgatggggataataaagaccagagatcttggacgcattggatggctgaatggctctatgatgtgcggaaagcctgcaagaaaggtgctccgatctgcctattcattgactggcgtcagtatccatcgattaccgatgcattgcagtgggcaggatggatctggagaggaacagcggtgtgggataagggaaactcccgtccacagaaaggtcgtttccgccagcaggctgaatacattgtgtggggcagtaacggaccgatgccaatcaaccgtccggtatcttgtctgccgggcgtcttccgatatggaaatccgcagaaccggattcatgtgacagagaagccgttgcagcttatgaaagatgtcatccagatttgcgaaccgggaggtctgatcctggacccgtttgccggagcaggaacgactgtccttgcagcggttatgacaggctatcgtgcagtgggaattgaggtaacagatgcctactacaaactgggaagtgacagagtgaaaattgcattagaagcagagcagaaagaggatgaaaagtagccgggatgtccaattggacatcttgttttttatagagaagatgagtggcatccaactggatgcaggaaggagatggagcgtatggaacaggcgctggcttatgtgtgctgttcagcagaagaaagccgggtgaaagtacagaaatattgcagaaaaatctatgaacttgggtatgtaccaatctgtccgagatttgtattctcaccattcttggaagaatccgatgcagaagatatgcagggatatggaagaatgtcacatatccttttgcggagatgccggatggtagtcgtatgtgggaaagatgtgacaggaacaatgaataccgaaatcagtatggcagacagactccatatcatttgtacgacacttgatggactggtacagataaaagaatcaaaataaatcagaagcgggtaaatccggtgctacagaaactggcggtactcgttttgcaagcatagcgtttggatatccaaacgcactttggggagaaccccaatcccccggacacagacggaaatggaaaggaaggatcaagtcatgttaagaaatggagtaatgattgtaatcgcattgatgagcggaggatttataggagtgatagtgacctgttgcatggttgcagcgaaaaaatccgatgaggatcttggcggtatgatgaaagaggaagagaaaaaagaagggacggtgatgcaatgcgaaaacgaaaccatgtgatcccggtgcggttaaatgcaagggaactcagggaattggaggaacaggtggaaaaaagcggactgagtcgggaagagtttatgcgttcgctgatcttaggagcgcaggtacacgcaaaaccctgtgagcatcacccggaactgcttaggaagatagcgggtctgtgcaataatgcgaaccagcttgcccatgttgcgaatgcttcgggaatggcaagtgagcagagtgtgcaggaaatgctccggcttaccaaagagacatggcatctggtaaaggaagagtggtaatgacagatggcttatacaagtgttatccccgtccaccgcctggaccgttccatcgaatatgtgaaagacaaagaaaaaaccacacagaaagcagactctctggaggctgccattgattatgccatgaaccggacaaagacggaacaggcggtcttcgaagataccatcggatgtaccaatgaaaatgcgtatgcagatatggtggcaacaaaaaagagattccataagatgggcggtgtggaaggataccatctggtacagagttttgcagaaggtgaggtgacaccggaactggcacatctcatcggacaggaactggcagaccggctcttaaagggacagtatgaagtcgttatcacaacgcatctgaataccagacattatcataaccacattgtctggaactctgtgagcatggcagacgggcgtaagtaccacagcaatgcaaagagttattatacggagatccggaagatctccgatgagctgtgcagaaaatatggtctgtctatcattgaatccgaccagaaaaaatcaatcccttatgtacagtggaaagcggaacaggaagggaaaccgacatggagaagtgcgatccgtctggatatcagggagtctgtacaggaaagctactcctggtcacaattcttaaaagaaatggaaaagcgtggatacacatggaaactgaaccggaaatatgtcgctttaaaggctccggggatggaacggtacatccggctacggtctcttggaaaaaactattccgaagaggagatccgtggacagatcttacagccaaaagtaaaacgcatctatcaaaagacggtgcagatccctccaaagaggaaactgaccgggatacaggcattatattattcctatctatatcagatgggagtactgccaaaaagaccgagaagaagtccgtatgccatcagagaggatatccggaaactggatcagaggattgaacagattgagtttttaatgaagcatgacattacgaccagagaacagcttgctacataccgtgagccgttacaaaagcagatttcagaactgatgaaggaacgcagaaagctctatcggaatgacagtgaagacagtggaaaagtacggctgtccgaaatcaatgaggaattaaaaaatctccgaaaagaagtccgtatgaccgtccggattgaaaagcattcattggaaatcgaagaaagacttcgaaaggcagaagaacaaaaccagaatgagaaacgtgtggaacacaaagaaaaagagagtcaggaggtgagataagtatgaattacggagcagaaccggctgatcaggtggtgcggtacagtctggaaggaatggaatactctttgaagattaccggaaatgtggcaaagcatgtggcaatctttattgcagccgccctgaaagatcagaaaaagacaagagggaaaacaagacttaccagaatgttaaaggaacagcgcccgatgaaattttttactgttccgggtgaccgtctgaaagaatttgcaaaagaggcaaaggcgagaggtatcttatatgtagtcatcaaagataaggtgaatccggaccagacagaggtcatggtatttgcagatgatgccgcgaagatgaacagggtactagaccggatgaatctggattttgtaaaagcagaatcaggctctatggttacagaagcagtggaaagagtgactgcaccggaaaagacagaaaatcagatggaaaaagaatcaagggagaatgtacggacagagaccgttgtcctgccggaaggcaagatagaatttgaactggatgatgcggaagaaatgtttcagattggggatgaggctttcccggaaggaaattttacacatgcgcaggaggggaaagcaaagaatccgtccgaacctttctcgcgcaacaaaaatatttcttccggtcgggaaactagctgggaagaaaagaatgaaaaaccatctgtgcggaaagaactcggagatatccgtaaggaacaggaagagaaacgtaagaggccggacagacggaaaaatgccagagagagcaggaagaaacgtaagaatatgaaaacgaaaggcaggtaatgtatatggatttaacagatatgatttcaggtggaacggaagaacagcagattcctgaacagaaattgaccaaggaagaatatgcagccaagaagcagcaggaaagagaagaggtatgggctgaagtagattcacaggcacagggagtttttcaggatggagaaaaactgaaaggctttctggattttatggcagagtgtaatacacagagaactccgaatctgcttttgatctacggacagcatccggattttaaggtggtaaggtcttatgaacgctggagagaagaacaccgttcagtaaaagcaggggagcatggcattacttatatgatttccactgaatacgaaaaagacggagaaatgcggagagggtatacgatcggaaaaggatttgacatcagtcagatgtcaggaaagccattggaagaacgccctcagcgaagtctgacagaactgataggaactgtcttaaaagaccagtcggtacgtgtgcagattgaggatgatctgccagacaaagtgcaggcccagtacaatccgagataccgtaccatttatatccgcaacggaatgagtgaagtaacgacattccatgcactgaacagagaactggcgtgtgcagcactggaccagcataccggaacctacagccgacagaaagtcagtgcacaggcttattgtgcagcctatgtgattgcgaaacgttatggtgtggatgtcaccggattcaatctggagtatattgcacagaggaatgaatgcggaaagaaagatccgcaggaactgagagactttttaaatgatgtccgtcaggcttcctacagtatacgaaaccatatcgaacgcaattttggtgcaaaggaacaggagtatataaccgatgagttcgcaatcggagaccctgtaaaaataccggaaaccaaggatgaaaaaccatctgaaaaagcatccggaaaagagaaaaaagcaaagagccaggcggaacgataaaagtgaaaaagctggacggttggagtagctattacggaggtcttgtgatatggttggtgtaacaaaaaaaggaggtcagccagatgacaaaatactatttgaagatggataacattatgaaaaatatgttcgtggtggcactgaatgatgagctgcaggcacagaatgagcaggacgaatgtttggaagagacgaaagctcttctgaaaaaagtaagtgaatacgacctcgcccagaaacggctgcagattacagtcggggagcagaggcagatccgtaaggcactgaacagactcagaagtaaatatcttgcagccggaagatacagtgacggaatagataaagtcatccttcaggttgcaaaaccgaataccaccagacacatgttctggtagagaaaggagtggttgattggtcatttattcaagagaaaaagtggcacgacttagagaacagtatccggcaggaacaagaatctgtctggattcgatggacggagaagcgggtatgccgcagggactggaaggaactgtgcagtatgtggatgatgcaggtcagctcggtgttaagtgggacaacggcagaagtctctcactgataccgggagtggattcctttcataagaaagaaggacagggacatccagaagaaaagccacgcaagaaaagagaatctgacttgcagagataagtacaaaaaagcaggactgggttctgtatcttgtttttctgccatttgtctggtgggcggcagcgattaccgcttgtgccattacaccggataagaattttattcaaatcttagaaacgctgagcgaaaaactcgaacagccgttttttatcacgtatacaccgtatacgttcaaatgtattctgatattcacagcagcctatttcttaggcattggtatttatgaatcccaaaaaagaaattatagaagaggcgtggaacatggttccgcaaaatggggcaacgtgtccgaaatctgcagacgctactgcgaaaaacaatacacgcagaatctgcttttaacacagcatttccgcatgggactggacggctataagcacaaacgaaatctaaatgtgctggtagtcggaggttcgggagcaggaaagagccggacgtatgcaatcccaaacatcatgcagtgcaactgttcgatggtgattactgatcccaaggcagaacttttgcgtaaaaccggaggtgtcctggaacggaatggatatgaagtccgggtttttgatttgatcaatccggagacttcctggtgttataatccgtttgcgtatgtccgggatgataaggatgtactgaagctgatcaataacctgatccgcaacacaacaccaaagggtgcgcagagctcagacccgttttgggagaagtccgagactgcacttttgcaggcacttatgctgtatttgctgcatgaagctccaccggaagaacagaacttcccgatgatcatggaaatgcttggaagcgcacaggtcaaagaagatgatgaggattaccagtctccattggacattttgtttgaaagactggaaatgcgggatccggagagtattgcggtcaagcagtatgccatttataagcaggcggccggtgttgtatgctctaaaagacttcttaatcaagcggttgggaagtctcttagaacacacaacctaaaaccgaagaaaggagcgcaagttatgagaaaaaacgagaaaatcactgctctgtacgaacgactgagccgtgatgactttggcaaagatgatgaccaacagcgtgagagcaattccatttccaatcaaaaggctatgttggaggagttcgccgcccggcagggctttacaaacattgtccatttcacggacgatggcattagtggtacttgctttgaccgtcccggatttttagcaatgatgaaagaagtggaagccgggaatgtggagtacctgtgtatcaaggacatgagccgcatggggcgtgactatctgaaagtcggtcagattatggaaatcctgcgtcagcgtggcgttcgccttatcgccatcaatgacggcgtggacagtgccaaaggggacgatgattttacccctttccgcaacattatgaacgagtattacgccagagacaccagccgtaaaatccgttccactttccagtcaaaaggcaagtccggcaagcacctcacaggcacggtcatttacggctatctctggaacgaagccagagaccaatggttggttgaccccgaagccgctgatgtggtcaagcgcatctttgccatgacgattgacggctacggtccgtatcagatcgccagcaaactgaaatcggaaaaggtgcttattccgtctgcttaccttgcccggcacggcgagggcgtgaacaaaaacaagactttcaaagatgtgtacggctggggttcttccaccatctgcaacattcttgaaaagcgtgaatatctgggacacaccatcaatttcaagacccgaaagcacttcaaggacaagaaaagccattatgtcccggaggacgaatggacaattttcgagaatacccatgagcctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggaaagctctgcaagacccagcaccgtatcaatgaagatgtggtactgtcccttgtctctgaaatgctcaaagccattgccgagtatgcgaagcatgaccgagccgagtttgtccgtgtggtgcaggaagcgcagtccagccagcagacagcagaggttaagaaacagcggatacgccttgccaccgcaaagcagagagtgtcggagctggaagtcctgctctgtaaaatctatgaggacaacattttaggaaagctgtccgacagcagatacgccactctggacgctcaatacgaaaaggagcagaccgagcttaccgctgaaatctctgctctggaaaaggcagtcaagagctacgagaagcacgaaaaggacgctgaccgttttatcgctctgattgacaaatacgagaacttcgacaagctgaccattgctatgctcaacgagtttatcgagaaaatccttgtgcatgagcgtgaccgcaaaggcagtatacagaccacacaggaggtcgagatttacttcaattttgtcgggcgatttgttcccccggcgtttggagaagtggagctgaccccggaagaattagaggaaatccgcaaacgtgaggaacgcaaggacaggcttcatcagaactacttgaagcgtaaagccagcggagcgcagaagcgatacgaggacaaaatcaaggggagaaaaaaggcagaaatcgaagccaagaaagccgctattcgtgcggaggatattgcaaagggagtgttcgtccctgtcagcagtttaccgcagagagagccgatgaaaggagtacaaacagcatgaatatcacttatacacagaacggcgattatcttatcccgaacatcgttatccgcaagaccaagcccctcggacactacggcagacttcgcaaggcgtatctggaaatgcaccgtccgatactgttcaatgagctggtgctatccgacaagctctttgagcattgcgccgagattgacgaagcggcacgaaaccgcatggagctgatcgtgcggtcactggcagagcaaaacggcgtgaccgagcaactaaaagccaaaaaccaaatggaatgggtgcggcagatgaacgcttgcaaggcacaggcagaggagattgtgaaagcggaattgatttatgattgagcgaggaagtccgggcagaaaactgttcggacttttctcatgtagtccaaagttgcggtagaattgttcacgagttttatggtacaatttatgcgaataaagaaaacggaaaattagaatctaacaagagaatgtggttgtatgaaaaaatccatattagtattttgggcaatcgtgtgtctgttacctattcaaaggaggtttaagaattttaaatgaaacatataagaaatatattgctgttgattacgattatttttgcttttgttatgcaagctgaagtatatcaaaatatgctctggaactttaatggtgcttattatttatcgtccagatacacaactactaatgacgatatggattcatttttagccaatgcagaagatacagctgagaagcatggtgttcatattttttcgacttttaatcagagagtttctaattatcagacaagactttatatttatggtgatgataccgttgttcgggatagtcttaaaagcacaatggatattgaggaaaaaacatatacggctttgataggcggaatcaccgtaatagaatttgaagattttagagaagcaaaaaacacaggcaatggacaggaaataatggtcagctatatcggtgacgatgatgacattattgccacatatcaagatttggcaaaagaatattctatatcgcagccagagttttggcaatcaaccgaaactgatatgatgttcattgtttggggcctggttgccatattgatgattgtacttaatatgattgaggtgatacgcagacaaaaggaagtagttgtacgagcttctctgggcgaaaatgctgctgtgattgctctaaaagctgtagtggctgatatgatttcatatgctgcattattcgtcttagcaaagttgcttgtttctcaatttatatcgggagcgtatgaagatcatctcattttggcagtgtattgtgccggagcagttctttccgtaattccttatgctgcttttgtccgctttgatgtaaaaaaagcctttgccaatgcttcagataaaaaaggtatgttttatcttctgaacggtcttaaagtatttgctactgctatgacgatttttacaataactacaaatctcagtagcattcaaggtaatttacttacaaacactactcttttagaaaatcattataatgattactattttggagttatgcagattgaacctccttttgaagaaaatgaggaggaatccaaagagagcgaattttggaatgacctttacgaaaatgaatacaacactataaatccggtggtctgcataggcagccggataagcgatacggataattatatttttgtaaatcataatgccagagatatgctgcaagggttttctgatatgcttactgaagatgatgaaaaagaggatatcgtggtcttcgtgccaaagggaaaaaatgcggaatcatacaaagatatcgcaaaagaggaaattgactctcttacccaaaatgcagaagaactgcgtgttgtttataaagaatattctggcagagagcaattttattatctcaattcgaacagagaagaggctattgacggattgtcaagagcaacaaatccgattgttatttatcaggcaaatgaggctgttgctttgaatggaagttatatcgaaacaggaacatataatggtgaggtgatctacggatgcgatgaaagcacaattcgtaatgctgcgaaaaaatatgcagaacagcttggtccacactattttatgctgacgaatgtcggggaggattatacttatagtcatagtttcctcgtgaaactgattggctttataagctctctttgcgtattagtattgctgttagatatcgctatcatcatatctgaagtgaaaatggaatttagacttaatgcgatggaaatctccctcaaaaaggttttgggctatcgcttttatgaaaggcacaaaagatttatttccgttaatctcttagaaaatatagccgttgtgatattgatttgcattgtttcgctttttatatctaacgcaagtgtcgggattgctttactggttggagcattgctcaccattattgaaatggcaatcattttcacaaatgttatgtgggttgaaaaaacaaatatctcaaagtccttgaaaggtggatgtttatgattataattcgtggcttaaataaagcatttggagagaaaataattttctccaactttaatttggaaattccggatggaagttttgtagtaatcagcggggatagcggcagtggaaaaagcactttgctcaatatgattggtggtatcgaaaagccggatagcggcagtatcataatcgaagggctgaatattacccggcttaaaaataaaaacagtttttttgcggatacagtggggtttctttttcagaattttgcactgcttgaaaataagacagttaaagaaaatttaagtttgattaaaaaatcaagccgaactaaagtatcacttaaagaagctcttaatcgtgtggggttatcaaaggaagttaacaaaaaagtttatcagctttccggtggtgaacaacagagagttgctttagctcgtcttatgatgaaaaaatgttctgttgttttggcagatgaacctactggctcacttgacaagaaaaatagagatattgttatgaggttattgcacgaactcaatgaagaaggtaaaacggttatcattgttacccacgatcagggtattattgaagatgaaccttatgttgtgaaaatctgagagtacctcttagaaatgtcttgatctacattttatgtaatttgggtcagaagaaaatccctttaggaactaaagggcgcacttctatactctcctatcgggagtatcgtgcgtcctgcggagcttcattcccggtcagcagaaaaaagctgcatgcctgagaatgtttcgtcacttcgttccatcaagggagctacactcccttgcgacgcttgtgcgtctatcccttgtggacttgccgtccgcaaacagcatgaaatgctgttcgccgccagcaagtttgaaaaaccgaataccgaaaatcagaccgttgactggtcgcaatgtgcgaaaagttgacggtctttttttatccccaaaatcaaaaaaggaggtcaagcacaatgacaaaaccgaaaacccttgaacagctccgagccgaaaaggaacgagctgagacaaggcttgcacaggagcagcacaagctggagcgtctggagaaccgaaagaaatttctggaacaaggcgaaagaaagaaacgcacccaccgcctttgcaatctgggcggcacgattgagagccttgccccggaggtcaaagatctcacacgcaccgaaatgacggagctgatggagtacatcttttctctgtccgaagtccagcgagccgtccgtcacatggcgattacccacatcaaccaagcgagcagaggaaaggagttgaaagccgatggcactatttcatctgagcgtcacgcagactaaacgaagcgcaggacagtccgctatcgcttctgctgcctaccgttccggcgaaaagctgtatagcgagtattacggcgaatacagcgactacaccagaaagggcggcgtgatctgctctgacattctcttgccgtcccatgtaccgccagaatacgcagaccgccagaccctatggaacgccgtggaaaaagccgagcgtggaaagaacgcccaacttgcatacagctttgacattgccttgcagaatgaattttcccttgaggaaaacatcgctcttgcaaggcaatttttattggagcagtttgtgagccgtggcatggtggttgacttcgctgtacaccagccagacagagaggacggcggcatacccaatccacattttcatgtgctttgccccatccgtcccatcgagcagaacggcaaatggggctgtaagcagcaccgagtttacgagctggacgaggacggcaaccgtatccgggacgcagacggaaagtttgtgttcaacgccgttcccactaccgactggggcagtcccgaaacgctggaatactggcggcagacatgggcggagctatgcaacgccaagtttgcggaaaaggggcttgacattcgtatcgaccaccgaagctatgagcgtcagggcgtggagcttcttcccaccgtccacgagggcgcaaccgtccgggcaatggagaagaaaggcatacgcaccgagaagggcgagttcaaccgctggatcaaggcaaccaatgccgttatccgggacatcaagaagaaaatcgctctcctgttcgattggattgccgaagcaaaagcggagcttgccaagccgcaggcacccaaccttgtttctctgctgaacgcctattacaccagccgcagagccggggcatattcgcagaaaggtaaggtcagcaacctaaaggagatgaacgagactttcaattatctccgggcaaacggcatttactcccttgaagatttggaaagccgtgtcagcgaacacagtgctgccacagagagcttgaagaaaacgctggacgaacagactgcccgaatgaaagcaattaagcagctctatgacagctccgctgctttccagagcttgaagcctgtctatgacggcttgcagaaaatcaagtttgagaagcccagagccaagtacaaggcagagcatgaagcggaactgaaacagttctacgccgccagacgtaagctgaccggagagttcccggacggcaaggtggatatgaaaaagctgaccgaagagtatgacgagctggaacaggcgcacaacaccacctatggcgagtttaagaccgtcagagacgatttacaccgtctttggaaggtcaagtcatgtgtagatactgccgcccgatttaacgagcgtacagaggaacaactgcaccaaaatcgaccccaaacacgacacaaaaaggaggatatatcccgatgaattacacccaagcacagattgaccgggcaaacgccgtcagtctggaagattttctccgcacacagggagagacgcttatcaaaagcggacgggaataccgctggaaagaacatgacagcctgaccgtccggggaaacaagtggtttcgccacagccagagcaagggcggctatcccattgattttgtcatggagttttacggcaagtcctttcccgaagctgtccagctcctgaccggcgaaagcggcgaggggcagaccgaagccagcacagcaccgcccacagcgttccacttgcccttgcacaacaggacagccgacagagcaattcaatatctcacagaaagccgaggtctcaacaaaacgcttgttgaggcttttcttctttccggggatatttacgaggacgcaaagcggcacaatgttgtgtttgtcggcagagaccgaagcggtacgccgagatacgcccatgtgcgaggaacggcagacccattcagacaggacattgtcgggtctgacaaatcctatccgttccgacacgagggtaatggcaatcagctctttgtctttgaagcgccgattgacctgttatcgtttatctgcctttatccgcaggactggcagacaaggagctaccttgccctgggcggcgtttcgggcaaagcccttgaccgttttctttctgaacgcaaggacacccgaaaagtgttcctctgccttgacagcgacaccgcaggaagtgaagcctgcacccggctggcacaggacattcccggcgagatcgccgtcattcgccttgtcccggcaaggaaagactggaacgatgttctccgtcagcaaggggacattcccagccgcaaattcatagccgagacaatcacgctgcgagagctgcccaccgcccagcctgttcccatgctccgcatggcagatgtggagctgacgagcgtggattggctatggtttccctatatcccctttggaaagctgacgattatacagggcaaccccggcgagggcaagacctactttgccatgcgtcttgcggcggcttgcaccaaccgaaagcccttacccggtatggagacccttgagcctttcaacatcatctaccagaccgcagaggacggtctgggcgataccgtcaagccccgactgatggaagcggaagcagaccttgaaagagtgcttgtcattgacgatagggacacgccgctgacccttgccgatgagcgcatagcaagggcaatccgggaaaacaacgcaaggctggttatcattgacccggtacaggcgtttctgggcgcagatgtggacatgaacagagcaaacgaggtgcgcccgatattccgcagtctgggagacattgcacaggctaccgggtgcgctatcgtgctgattggacacctgaacaaagccgcaggaacgcaaagcacctaccggggattggggtctatcgacattacggcggcagtccgcagtctgctttttatcggcaagctgaaggacagccctacaacgagggtgcttatccatgagaaaagctcccttgcgccgcccggacagtcccttgccttttctctgggagacgagaaaggctttgagtggataggggcttatgacattaccgctgacgagcttcttaccgggacagacaccgccaagacggaaagtaagaccgcacaggcagaaatgctgatactggaactgctggcagacggaaagaaaatgccgagtgcagagctggaaaaagcggtcaatgacaggggcatatcctcacgcacgatgaggacagctaaaagccgtattggagacaggcttgtgaccgagaaagacggcacagcatgggtctgctatctccgaagctgacgcaggaacacggcaagcatggcaaagacggcaaggtttttatagataccttaatgttgccgccttgccttgttccctcataccgacaccgcccgatgatgaacagtcaccgggcatttttcatttacaggaggattttgaatgaacaataccgcaaccaacagcaccccttgcccgactgtcagaaagcagatcggcaagacaacctatatcgtccgtgtccatttcagccagaccgccaaagagacgatggaggacaaaatcaagcgtatgcttcgtgaggaagtccgcaaaatgtgacttctttgtgaatttgatgaaaaagtccttgacttttcgtctctggaaagactgcaaagtcgattttaatctcggttggtgtccgtctggcagcttttaacctgaaacagatcgccaacctgacctgtacagacgaactggacttatacagcatcggggagaagaaagtagcactgttttgctgtattccggatgcggacaccagcatgaattatctggtcggcatgatttacagtaatctgtttcagacactgtattatgtggcagaccggaagtacggaggaaggcttccaattccggtacactgcattatggatgagtggccaaacgtagccttgccggatgattttgacaagattctggcaaccatgcgttccagggggatttcctgcagtatcatcatccagaacatcgcacagatgaaagccttatttaaagactcgtatgagagtctgatcggcaactgcgatgaatttttatatctgggtggaaatgaaaaagaaggacataagtatgtctcggaattattgggaaaagagacattggataccaatacctacggacagacaaaagggcgtagcggcagctattcggtgaattatcagcagactggaagggaacttttaacaccggatgaaatacggcttttagataaccgcaaagcgattttgtttattcgtggggagcgtccgatcatggacgataaatatgatttaaaaaagcatgtgaatttcagatacacagaggacggtggtgcatcgccttatgattatgcgaaaacaccactggctcacgacgacctaaagattgacattaacagattagacgactacgaactgctgtctaccgaggacatccttggtgaatagcagttttttgatggattggagtgatgtgtattgaagaaacttctcacaggagaaaaaaatagaacaaaaaagaatacaactgaaaaaatgacaaccccaatgccgatgggtagaaaacagaaaaagtggatgagcctttacatggcgctggtactgaccgtaacggttggagcaacgaccgcattcgcagccggagatccgttgtccgttatcaataacctgtctacctttattttttctctgattcgtgcgatcggtttgattttgcttggatttggtgttgtgcaggttggtctgtctttaaaaagccatgatccaagccagagggcaaatggatttctgacactggccggaggggtaattattacgttcgccaaagaaatcctcgatttgattatggcgtaagcctctttgaaaaaatatatcaggaaacagcaggagtgccggaaggtactcctgtattcaaaaatatgtttaaggaggtgagagtttttgagtgataactggattgtacagaatctaaactcagcactatccacatggagtgaaaagatggcagaactgtggactctgctgactgaaaatccggcaacttttaagggcggcggcatctggcggattatggtaaatattaatgatgcactgacagccattgcttatggattactggtattatttttcgcagccggaatcattaaaacgtgtggcagttttacagatctgaaaaagccggaacatgtgctaaaagcatttatccggtttgcacttgctcagggagcaattacatacgggatggaacttatgcaggcactgttttccattgtgcagggaatcgtgacaaccgtaatgagtggctccagtatggcaggaagcgtgacggaactgccaacggagattgtagataagattgagagtgtgggaatgttggaatccattccattgtggattgtcacactgcttggcagtctgctgatcactgtattgtcatttgtaatgatcctgacagtgtatggcagaatgttcaaaatctatatgtatacggcaatcgccccgattccgatttcctcatttgcaggagaacccacgcagtccatcggaaagaactttattcgttcttatataggcgtgtgtctggaaggggcaattattgcactggcatgcattatcttttctgcttatgcggcaagccctccggctgtcggagatacggagctgagtgcagttacaatcgtgtggaactatgtaggagaactggtattcaatttactggtgctggttggagcaattaaggcatctgaccgtattgtcagagaaatgatgggacttggaggttaaaaatatggatacaaagaaaacattaagatataactgggaatttggacgtgagacagtagcaatacgagcgagctcttatcggaacaatggaaatttatatgtaggactctgccataaggaagggagagaatgggaagattttggagatgtaaccattaatctgccttatcagttcttagagccaaatgaggcttttataacaggagattttaccaaggatatgcttcattttatcaaggaacataaacttggaaaagtgttgaatgaaacaggaagatcaggatatacaacctatcagaaggtagcgtttgatctagcaagacttgcggaatttgatccggaaggcgttgcggaacactgtagatttgccgggatagaagtaccgaaagaaaaaccacagaaaacgaagaaacaaaacaggggagaggaacgataatttatggaagtaaagatgaacaaagaaatcagggactatcaggaatccatgtttatgggactggacctgagacaatgtgtgtgttctgttcttgcgattcttacagcaatcggaatttactttggaatgcgtgatattactggacaggaaataaccggatggctgtgtgtgcttggtgctgctccatttgctgcctgtggctttttcaaatatcatggtatgacagccgaacagtttttatgggcagtgatcaaatccgaattgctgtatccgaagaaactggtgtttcagtcggaagatatctactactcctgcatgcaggagaccatctcgctgggagaaaagaatcaaaaggatggagcggaaatcataaaagagcgggagcaaatagcagaagcaaaacagagaaagaaacgcaagggaaggagtgatgcctttgattaaaactttaagtcaggcacttcggatggataaggaacgcttcaaagttccgaaatccgtccaacaggcaattcccatccagcgaatctggccggatggaatttttcaacagggaacgaaattctcaaaaacatatcgttttacagatatcaactattatattgcgagtaaggacaataagacagaaatgtttctggattattccgaactcttaaatgcactggattccggcatttctgccaaaattaccatcaataaccggagaatcaataaagaagaatttgaaaaatcaatcctgcttccaatgaaggaagatggactggaccactatcgggaagaatacaacgaaatgctcctgtctaagattacaggaacaaacaacagcatctatcaggaacggtatctgactgtcagtgtacataaaagatctattgacgatgcaagaacctattttgcacgtatcggaacagacatcgtaacacatctggcaaagttatcgtccacagcagaaggactggacgcagagagccggctccagatcttccgggactttttcaaaggagatgtcccacaggcatttccgtttgatctgaaacaatttgccaagaagggaacaagtttcaaggactggatgtgtccggattctatggaatttgaacgtgaccattttaaaatcggtgacaggtacggaagagtcctgtatatgcaggattatgcaagttatgtcaaagatgacatgatttcagaactgtgtgacttcagccggaatctgatgttgtcgattgacatcctgccagtccctacggatgaagcagtaagggaaatccagaaccgactgcttggtgtggaaacaaatgtgaccaactggcagagaagacagaatgcaaacaataacttttctgccatcgtcccatacgatatggagttgcagaggaaagagacaaaagaaatgctcgatgatctgacaaccagagaccaacggatgatgtttggaattctgacgatggtacatctggcagacagtaaaaaacagctggattccgatacagaactgctcctgtcggtggcaagaaagcatctgtgccagatgtcaacactgaagtggcagcaagtggacggactgaatacagtgctcccgtatggactgcgtaagatcaatgcgctgcgtacactgacaacggaatctacggctgttttaattccgttccatacacaggaaatcctgcagccgggaggcatctattacgggcagaatgcagtcagtaagaatctgttggtagccgaccggaagaaactgatgaatggaaacagtttccgattaggtgtcagtggatcaggaaagagtttctcggcaaaagaagagatcgtgcatctggcattgagtaccgatgatgatatcctgatccttgacccggagtccgaatttacaaaattagtagaggctctgggcggacaggttgtaaaagtatctgcgacatcagacaatcacctgaatgcaatggatatggacgcagcctacggcaatgaaaagaatccactgattgaaaaatcggagtttatcctgtctgtgttcgagcagttggttggagcaggaaatctgtcggcaaaagaaaagtcgattctggaccgctgtgctgcagatgtgtaccgggattatatccgaagtggttataccggagaagttccgacattgaaagatatgtaccgacagctgatgttacagccggaagaagaggcaagaggactggcattatcatctgaactttttatcaatggaagcctgaacacctttgcacagccgaccaatgtgaataagaagaacaggatcatggattatgacatccgggaactgggggaacagctgatgccgcttggaatgctggttaccttagacagtattttcaacagggtaattcagaactggaaagaaggaaaaacgacatggatatttgccgatgagttctatctgttattccgctatgaatacagtgcaaatttcttctaccgactttataagagaatcagaaaatacaatggattcgtgacaggtttaacccaaaatgttgaggaacttctgaaatcggacactgcaagactgatgttggcaaacagtgagtttttgattcttttgaatcaggcaagtacagacagggaagaactggcagctcttttgaatatttccgaaaaccaactgtcctatattacaaatgtatcggttggtagtggtctgattcgttgctctggaaatatcgtaccatttgagaatacgttcccaaagaatacagacctttataaactaatgacaacaaaaccgggagaatcataatgaagaaaaaagaagaagtaacgataactttttatgctgcagagtgcggtgagttccatgatttaggagaatatacaaaatgcagaacgttggaagaggcatataaaaagtaccagaaatattgtagaacatctgccaatatgtgtccggctattgagttttccatccatgatccgtactctatttattcggatatggaatatccattgccgttgtcatcaaaagacaggggtgatttggagcttgtgccatattacaacgagcatccactggtaaatgaagcaatcagacagttggagcagttgcagaaacagcaggaaaaaaagaaacatcgggatgttgcccgatgagataagagatacggaaagagggtgaccggatgagagatatcaaggaacgggtaagggataagaatccgaagattcgaaatccggatgcccggcttccgaaagaactggtacgctcggctgtactggaagcaaaagaaaagccaagggaactacatgagaaaagcagtggtcagtcagactctccaacacagtatggcattgaaaaaatagaatccgtacagtacagggcggcgagtgtggcaggaaaaaccatagggaaaaccacatatcgaggtgggaaaaaacttgccggagtgacctacaggaagataaaggaaagaaaacgcagacaggaagaagcgaaagctgccgaagaagcaatggagcagggggcagaaagcggaaagaaattgatcaagctgaaaccggagcaggcagcacttgccaaagaaaacggtaaacggcaggtaaaagcagcaccgagagtggtaaaagtatctggtctgtctcaagaaaaaatcaagacacaggcatccgtacagacacagcaggtggaaaagagccttcaggcgatgcagaaagcaagagcagtccagatggcaagaaaatcagcacaggcatcgacagaaagtggaaaagcagtccttcaggtaacaggaaaaggctcaaagttatccgtaaagggaattacagcagtgattcaaaaaggggtagtagctcttgaaaaaatgggaaaatggattgctgccggaggcggtgcatttcttctggtatttattctgattgcaggaatcattgcaggagcagccttcagcagtagttcggaaaactccgaatctctaagtgatgaggtgctggcttatacttcggtgatgcagcagtatgcatcccaatatggcattccagaatatgtgtctgcgatacaggcgattatgatgcaggaatccgggggaagaggaacagacccgatgcagtgttcggaaagtccgtacaatacaaggttttcacacagccccggttctattaccgatccgaattattcgatagaggtgggagtacagacctttgcagactgtatcagtcaggcaggatgcagcagcccacaggatatggacaagttaaaacttgcatggcagggatataactatggaaacggatacatagtatgggcgttgcaaagaggcggatacacagaagccaatgctttacaattttcacaggagcaggcagcttcgcatggatggagcagctatggagatcccgaatacgttccccatgtgatgcggtattattccggtggcagcctgtttgctggtttgtttggaagtcagcagattgtatcggtagcaatggggcagatcgggaacagtggcggccagaagttctggagctggtatggattcgacagccgagtagaatggtgtgcctgttttgtgagctggtgtgcagatcaaagcggtctgatagcaagtgggaatgttccaaagttctcattgtgccgtgatggagtgtcctggtttcagggaaagaataagtggcagagtggtggaacaaccccgacagccggaatgatcatctttttcgactgggatcacgacggaacatcagaccacgtaggaattgtagaaaaatacgaaggtggacgagtttacacgattgaaggaaattccagtgatcaggtacgacagaggaactatgcggtggattatgcctcaatcataggatatggggtgataaattgatggtttctttcataatttgttaaggattttataagggagttaatgaatcctttggaaaatagtcacaaaataggcacagttgattgataaattgttattgtaacttttagtgatagacatataaagagttagaaatctttataattgacttgaattaggaggtagtgaatatgagtgatcagaatgtaaaagcagcacaaaaatatttaaatgcgatgtttggtggacataaggattgggtaaaactggatgaagatggaaagaccggaacagccgtgatgcagggaatcattcgtgcatttcagattcagaatggaatctcaacgattacaggaacggttggaccacttactattaataccatgaagaagttagccattattacaaaaatggatccgaatgatactccgcaggttaatgtatgcttgattcagtgtgctctgttttgcaaaggatatgctgctggaggaattactggaatttattatacatcaggagtaaatgcagttaaaaagatgcaggaaaatgcaggactggaagttacgggcaaaattgattggaaagtttggtctggattgttatccctaaactggtttacaaaggtttctggtggggattccaatattgttcttattcaacagcaattaaatagtgattggtcagatgttattggtgttggaccttgtgatggaattgcctcaagacagacaattttgtctttagttggtgcattgcaggcggctgaaggagttacaactgaattaattacagatttgaattccgttaattttggcgatgcaacaacaaatgcgtttccgggtacattacagaacggacagaactcgatgaaatatgttccatttaataagattgctcaatacggactatattttaacggatataatccgggaagattcgatggcgtgtttgattcgactacagagtcaaaggtgtcagaatttcaggagttttatggcctgacaggaattggacttgtaacaaaaggaaaagtaaatgtttctactatgaaatcattgcttacgagtaaaggcgatacaaacagggcagcaaaagcgtgtgactgtgcaacagtattaaataaacaacaggcattagatataaaaaatgcagggtatactcatgtaggacgttatctgacaggttctgttggaaaagagcatacaccgaaatatctgacttctgcagaagtaaaaaatatagagaatgcaggattatcagtatttccgatatatcaggatgggggatatgaattaaactattttaaagatccatcacagggaagtgttgatgcacagacggcgattttagcggcagagagaattggtataccaagcggaacaaccatatattttgcagtggattttgactgttattcatatcagattgatacgtttatcataccttattttgagcagattcacatgatcttttttagttcgacaaatgacaaaaactataaagtcggcatttatgcaccaagatatgtatgtactaaagtttatgaagcaggattggcaagtaaatcatttgtggcagatatgtcaactggatttagctgtaatttgggatattcgatgccgaagaactgggcatttgatcaattttgtgagttgaactcattttcttcatcaccttcgttcccactggataaagatgcatattcagggagagatactggatttaaaaagttcgatgccgtatcgacaaaaacagatgaggaaatagcgcaagaaaatcttcgggcaaaggtaaaaatagcacgaaatcaatatgtctataatgtaatggagccgcttggttatctgaataaaattatggatgtgggtgtggagtatgataaggaaatttcactgggaacaatgatgagtcctcaaggagcaattgatatttctactaaaatatccacatcgcttgaaagttcaactggtaaaatttataatataaaagtggatataggaaatgatggagaattgacacaaacttgcaaaaatcaaattatggagatttcatcaaatttatcagatacaggtatagagggagcagataactttggaaatacgatagaaaaaattgctttatcggttaaatctggtaatattgcttttgaaataaataatgtttttgccaatagtgtagagttttccattgtatttagtacatcagatttgctgccagaagaggaaaaagagtggacaatatcggttgctttgatttttacaatgacattaaattctaatagtggtcttgaatttaatgttgtagaattcacaaaagagcatagtaatatactggcaggagccgtaatattagttcttgcgggtgcattagttgtaaatgcaattccgtcaattattgctttattttcagctggagcaggtactgtttttggtttgttgattcaagcgctgtaaattgtaaaagaataaaagagacaatggccagaggttcgattttataaagaggacctctggcaaaagggggattaagaagaatgcatattaaatcaattgtgtcagatgaggatagggaagaattagaaagaatgctttcgcttgggtttataattcctaatcaattatttaaaacaagacagaaaagtagaatgattatctatatttttacacctgtagaatttttactgtcgattaattgttatctgtcggaaagttatttgatgtttggaatagggattggaacttgtgtggcttgtgtggcttggattatttggtatcaaatgattggtaaaaattttgaaaaaaatgttcatgaatttgtctggggtagatcaggatatgaaacggtggatatcgatgaaaacgcaattaaaatagatgaagatcaaatttatgaatttaaaaatattgatagaatgttcttatataaaaacttcttttttttcataacaaatgaaaagaaaatatttatatttaaaacgacagatatggagtcggatgaacttataaaaattattaaaacaacagggattttatttgaaaaaaaagaaaaaccatttaatatttataagtattgtaaaaaaggaaaaagtttttaaaaataagcagaggatggtggatttatcatccttttagagaagagcatgtattttaaagggaatctggttttgcaggttccctttttgccatcaaaaacgttgatgttttatcaaatgacgctaaaaataaaaagaataatgcagggggtgacattattagttatcgctgtaatatttggataaaatataaataaaacataaaaaatataaataaattataaaatggcgacagttttttcttgttcaagtgtttattatatagaggacaaaataagacagcaaaggaagtggtgctgttgcatcggaaaaatgacacaaaattagtgatgtccattcgggaaaagaattgaaggggattcttttccccatttgtcgtgttacgaaagactgagggtaagaaaatatgctagaacttgcaatctgtgatgatgacatcatcctatgtaattggttagaacagaagctgctccattatgggaaagcgaatgactgtcagatatctatagaaatatactattctgcggagcagcttcttaacaggctggaagaagaatcctacgatatgttattccttgatatttgtctggaacatgagaatggaattgatatcggaacggagatacgaaagaaaaattatggaaaagaactgcggattacctatatttcaacatatcaggaatatgctatgaaattattccgtattcatccatttgattttcttgtaaagccaatccgagaggaagaacttttccgggtgataggtgaattacgggaactgttaaaagaacggaagaaaatatttgaatatacggatacaaaaggaatccacaagatttcttatgacaagatcctgtatttttatagtctgggaaaaagagtacatatcgtgacatcggaaaaagaatatgaatatcgaggaaaattaaaggatgtagcggatgtaacagaagaatatttcttactgattcacaagtcctatctcatcaatatggaacacgtggagcattacgaatatgacaacgtggttatgaaagacaagacacgtctcagtatcagtaaagcaaatcgcaagaaggtcagggaaagactattacaaacggagaagaaaagattatgaatatccatttgatcacttatctgacaagtaaattattctggatttatactgtgttccgttacaataccatcctgtatccaaaaaatgaggatacacaaaagctatttgcatatttttgtgcatatctgctttcatgctggggaagcatgcagtggggaacgatgtacggagatctgatctttgagctgatagctctgttaattataacagtggcatatcaggcagactggcaacatcatgtctggaatacacttatggtatatattatgggaattttatgtgatgggattccaatcgtgttctttcaacggtatgcggtagcaagaaatccggtgcatcatcacatgggaccgggaactattgtaatgggaaattttatattctttttactggaagtcattattgaaagaaaagtaggtgtaaagagaagttattatataaagaaccgtcattggcttgctatgctttctgtcccggtgatcagcattatagtctgtatcaggatattgctgccagacagaagaggtgtgcggtctacgattgtattattcttactgtttatcaatgtgtttattttctatctgcacgatgaggttcagaaaagttatattgaaacagcaaaacaggaagagatgaaaattcagatgagccagtatgcaaaagaactggagatgatgatgaaatcacaggacaggctgaataagatacatcatgattacaagcaccatcttacaacaataggggcaatggcaaaaacgggaggaaatgaagagattctatcgtatctgaaacaaatggagaatatagccggaacagccttatgtcatcatttatatacagaaaaccgtaatatgaataatctgctgaattatattttggaagattcgaaatcagtaattgaaaatccggagatttctgtagaaataccgaatcatataggggaagaattatttgatataagtataatagtgggaaatcttatggataatgctattcgtgggacagcagcttcagatgaaaggagattatcgtttcagatgtattatggaaaaggaatcatgaatatccagattgagaatagcataaaagatacaccaaaagtgcggaatggaatttatctgacaacgaaaagcaggaaagaaggacatggaataggattacaaaatgtgaaactcgtagtagaaaaatatcatggtcagatggagatctgccatacggagaaatcctttcaagtgaaaatattattatatatgaaattagatgaaaaatagtaaggcgatggtgtcttactatttttttcgaccgatttcgtctatttttgccacctcaaggggcatttttaccatttatgaaaattttgtgattttttagattatagtagtgccaaagtcagaaaaaaggagggtagcggttattttgtaaaggaattatagaaaaagattacaagagggagaaagagactatgaagagatttcgaaagtcggctatagccttagtacttgcactcctgatggcactacagggaacagagcctatttttgtacaggcaaaagaggccattgaggatgtacagaagaatgcagatttctccagaccagaggctttgacggaagaggaagcagggattacagattccacatctggagaacaagataagagtcagcagtctgatgcggacgtacaaaatgaaacgacgccatcagaagatacagagacgcaggaagaacagacaactccagcggaagaaacagaagaaaatccgcaggaaaaagaagtggagttgaaagaaccacaggattactatccgattccagaagaaccggaaggtgaactgattgattatgatgccatttccaagacttataagacaggggacaagcagtatacaaccgtttatggaggttatgtcggaacttataagaatgaggatggagataccgagctggttgataatacacttgtaaaaccagaagaagcagatactccggcatccgaagaagcacaggaagccagcagtgtagtggcaactgaagaaaaggaagagaaaacagaagtttatcagaacaaggcaaacgattatgctatccttcttccggaacagatgtcagaagagaatggtgtaacgattgaaaatggaaagaccagaatcgggatcattccggtagatggagattatacacattccgttattaaagacaatgcgatcctttataatgaagtttacgagggcgcagatgttcagtatacagtactggattccagcattaaggaagatatcgtacttcagcagccaacagacagggaagtctatgaatacgagctgcagattccggggtatcaggcagaagtaaaagacaatcaggtctatatctatccggaagggaagacaatcaaagatgcgaagtatcttctggagacgccatcaatggaagatgctgccggggaaatcagtttcctgatcacattggaacttcgggaagaagatggaaaaacaatcctgaccgtaaaaccagatagggattggctttcggcagaagaacgtcagtatccggtcaggatcgatccgacaccagtagagattcagaagagttcctttaacatgatcggtgtggaagagggaagtcctaccagtcagattggtgacaacaattatccgtatgtcggatttgatgatggtattaagtctgggaaccttgcaggatttggtactgcacaccagaactgccggacttatatcaaagtaaattcaaattttagtcagattccgaaagattccaaaattgacagtgcaacatttgcagtcagtcagaaaactgcatacagtggtggtgcatcccagtttggactttatcgtgtagatcagtcgtggaacacctccatcacatggaaaacaaaaccagtaaatcttacgtttcaggatgtacagaatgcaagtaccagcaggaacagctatatcaattatgacgtcaaagatctggtcaatgactgggtgcagggaactcatgcgaataacggatttgcactggtagccattgccgaggcaaataaccttggagcttctatgcagtgtgaggtactgaataacagggcatccgtttatggaccgaaactcagcatccagtggtcaccggctgaagatccatatctgcgagatatgtcactggatgaaacaacgatcctgcttcgcccgatgacagaaaagaatacaaatggaaagctgaagtttgatgccgtatttgcagacggaattgcaaagagcaaatctacagtagaatattatctgcttccagatgaggaaaatgaagaacatcacgaaacagatgcaaaaccattgtattcctatccagacagtactgaatacaataagcagttcccggaggcgaataagtattacagcaaagattccaactggcagagtgcactgtattcagggctgacgaaggacaagctttataagatcaaagcaaaagcatcgaaagagattgatggaaagctggaaacaggaaaagaagtgaccagtgacagctttgtgatctatgaagtgaagcagtttgatacattcccgaagattgcaaaatattatggtgttccgcttaagaacattatgaaagacaatcaggttatggacgcactggtagtcgcaaataacacgatctttatccgtaacccacagacaaatgttccatatagtcctgcaccgcttaccgatcaggataagatgcggattgacggagcattgatgggaagaggcctgcactgtgaatttggatttgaaccagtcaacttaaatactggtaacttctacatggatcagtccgatgcgacgatgaatgaactgaatggagaattctccattacaagaagctacaattccaaaggaacagaccagcattccatgttcggacgtggatggagctttaactatgaccagtcactttctcaaatggaggacggaagtcttctgtatatgagaggggacggaagttatctgatctttgataagaatgaagatggaagctacactactccggatggttatgtatatgatttaaaagcagtcagctataaagatacagaccatgactacatcggatgggaactgacagatgcggatcagagcgtctggtcatttgataaatatggagttttacgttatgtaacggatgtgaatggatttaagacagtattagattatgacgatgattataatctgagtaagattacaacaccatccggaaaaacattcggggtaaaacaggataaattcgggcatatcaaggaactgtctcttccagatggtggaaaagtttcttacaaatatgatgagcagggaaatctgatatctgtaacagatccgaatggaacaacaaaagagtacaaatatgatgatgacagccgtatgacaagctggaaagatgagaatggcaatacggttgtaaagaatacttacgataaagaaggaagagttgtagagcagactgatgcagaaaaaggaacggcaactttcaagtacggaaagagttctactacaacaacggataacgaaggaaataagaccgtttatcattatgatgatcagtaccgcacaacatccattgaatatccggatggaacaacctgtgaaaagacttataatgcagagaatcagcttgcttccgaaacgacagcagccggaacaaaaacttacacttatgatacatttggcaatgtagcaacggagacaagagaggatggaaagacagcctcttatacttataatgagcagaataagctgaccagtgcaactggatataacggagcaacggttacttacagttatgacggtaatggaaatatggtcacatctacaaaaccggatggaacagccattacctatacttacgatgacaaacatcgtatggtatcccagacagacggcagaggtgtcacaacaacgtattcgtatgacggaccgaacatgaccggatatgtggatggaaatggagcagcatggggattcacgtatgacgcgatgaatcgtgcagttaccatgacagatccacttggaaatgtaacctcgaacagttacgatgcgaatggcaatctgacttccaagacagcagccgatggcggtgtgaccgcttatacgctggatggtgtgggaaatattacagcaagtactgacgcactggggaataccaccacttatacttatgataagatgtacaacatgaccagtggtacagatccgaaaggaaatcagatcagctacgtttatgataagaattatcagcaggtcaaagcaaccgatgcaaaaggaaatacaattacttataagtatgacagcatgggacgtgtcatagaagagagtaataaagattttggaacaaagctctatgaatatgacaaagcaggaaatctgaaaaaatataccgatggaaatggaaatgcaaccgtatccaagtttgattctcttggacaggtgcttcagtccaaagatgcagttggtaatataaccaaatatgaatatgacgcattaggaaatgaaaccaagattacttatggagatggaagcagccattccaaggaatatgataactgcggaagactcgctaaagagacagatgaattaggtgcagttaccacttatacttatgatgcggcagacaatctggtatcaaaatcagatgacagtggaagaacctggacttatacctacgataatacaggaaaccgcttaagtgaaaccaacccagaaggtggaactaccacatatacttatgataaagcaggaaatctggtatcttctaccgatgaagagggaagaacagatacttatgcttacgacaaggcaggaaatctgactacatccaaagatgcccttggatataccgtatccatgaagtatgacttaaatggaaatctggtatcctctaccgatgaaaatggaaataccagtaccatgacttacgatggtaatggaaacatgacatcggtaagcgatgcaaagggcaacattacagcaatgaaatatgattccaccgacaatctggaacagacggtggatgccctgaaaggaaagaccacttacgaatacgattcacagggcaacagcacaaagatgacagatgccctcggcaatgcgtatagttatgtgtatgataaagagggaaataacacatccataatactgccgacaggggacaaggtgctgatggagtacgatgccatcggacagcttgtaaaatgtacggatgcacagggactcgtaattacctatcaatatgacggagcaggcaacctgatccattcctccgacaatggtggaaacagtatggattatacttatgatggtgccggaaatgtactgacacagaccgatgaacttggcaggacagcaacatacaagtacgatcagtacggcagactcctgaaacttactgaagcagacggaagtatcacatcttatgaatatgatgttatggaccgcattacagcggtaacggatgcggaaggtcataaaacaacctttacctacgataaagtcggcaaccagttatccatgacagaagaagaggaagccacatataaatacgcttacgataagaaagaccgggttatttctcagacaaatccactgggagcatccagcacctttaagtatgacggaaatgataatgtgacggaatctgtcgatgaaaacggtacggttaccaagtatgcttacgataaaaatgacaatctcgtatcccagacagacggaaatggaaatacgacaacctaccagtatgatgaactggaccgcaagatcggtgagacttctccgttaaaagaaacaaatgaataccgttatgatgccattggaaatcttaccaaatcaaaagatccgatgggactcattaccgaatacaaatatgacagcctgagtaacatgacggaacagatttctccaaagggagcagttaccaaatatgattacgacaagcatggcaatgtcatttctgtaacggatgcaaagggaaatgagacacagtacagtgttgacctgaatgacaatgtcacaaagatgacacaggcgaatggtggagagtatacctatagttatgataaagccggacgtctgaagagtatgaccagtccactgggttatactaaaaatttctcttatgataaagtggacaacgtggtaaaagaaagcgacagcttaaagagtaccactacttatacttacgataagctccataacatgaagtcttctaccaatgcactggatggaacaaccagcttttcttatgataagtatggcaatctggtgaaggagacagatccgcttggacggagcaatacctacagttatgacctggcaggtcagatgacttctgcagctgatccgcttggtaagataactgcttacacttacgacccggcaggaaatattactgaggtcaccaaaccgggtggaagaaagaccagctatggatatgataagaattataatgttacatctgtaacagatccgatgggctatgttgcaaagacagtctacgataaagacaaccgtgtaacagaagagaccgatgcactggggcagaaggaatcctatacctatgataaggacagcagggtaacttctattacagacaagcgtggattcacaacgggatttgattacgatgcacatgggaatattcaggttgttacagataagaccggattaaagagccatctggaatatgacaagaatgacaacctgaccaaagtaactgatgcccttggcggtgtaacaacttatggttacgacaacatggataacctggtgaccttcaccaatgcagcaaataagacaacgaattatacttatgacttagaaggcaacctgacatccatcaaagatccggcaggaagaacggagaaattcgactatgatgaaaaaggcagactgaccggacatacacaggcaagcggcaagaaaaccacgtatgattacgacaaactgaatgacctgttggagaaatcttatcaggacgcaaaaggcgagacatccgaaaaggacgtgacctacgcatataacagtgccggggaacgggtatccatgaaggatcagacaggcaagagcagctacgaatacgatgcacttggaagaatcaccaaagtgacaagcggttcgaaaaaggatgtcagctacgtttatgatgacgcagataatctgcaggcaatcgtatacccggatgggacaaagatcagctatgaatacgacttaaatgataatctggtaaaactgacagaccgtaatagaaaagtaaccacttacaagcatgatgcactgaaccgtgtgacagaagttactagaagtaatggaacaaagacggaagtatcttacgatgcagaagatcatatcacaaagattgtgaatacctgtggttcctgcggcaaagtaatcagtacttatgagtacaagtacaatgatcagggatatgtagttggagaaacagctacggaactggaagctggaacaagaaagacgccaagctgggaagactggtacaactggggcgatacacagaaagagacagacaaagcagactgtgagcatcaggaaaaagagatccagacgacacgtacctatgaatacgatgacaactgggaactgacacgctgtacggaaaaagcagagggcggtaaaaagacagtccataattatacgcatgacaagattggaaaccggacctcttacgagaagatcgaagatggtgtcagcaaagcaaaatataactacaagtataacgattccaaccagctcatcaaacgcacgaatgcaaaaatctggggcgatccgggaacaacctacagctatgataaagatggcaatctaatccaggaatgtgataagacaaacagtgcagatccggttacttatgaatacacagcagagaatcgtctggcagtcgtaaaacagggtggaacagtcctgatggcagccatgtacgatggagataacaatcgggtattcgaactggataacacttataaatgggaagactgctatggcgatgaagttctgattccggagaaccagcgtacagaagatggagacagtccgaaagaacagcttgcatctctggtaaaaggcggttccaatgccaaaggttacacattgacagagtatatcaacgatatcaatcgcgagaatacagaagtccttgcagagtatggagcagacgagaaagtacgtcaggcttatacttatggagaaagtggaatcggagaacgggtaagcgttgataaatcggaagaaagcagttattatttatatgacggaagaaacagtgtaaccggaatcctgacagaaaatgctaacctgacgaacagttatcagtacgatccgtatggaaaccttacatcaggaaccgcagatggagtcaattattacgcttacaatggggagtccacaaatgtaaaaacaggacttcagtatctgcgggcaagatactatgacgcagagaacggaacctttacaactgaagatagtgaccttggaacgacagaaaatccattaaccagaaatcgctatgactatacgaccaataatccgttgaattacagtgatccaacaggacattccttgtggagcaggattaagggtgcagctaagaaagcagcaaaaaaggttgtaaaaacagtcgtaaatacagcgaaaaaagttgttaaaacggttgcaaaaggcgtaaaagcggcagctaaatgggtgaaaaatgcagtatcccatccaaaacaggtaatacagaaagctaaaaataccgtaaaacaaaaagcaaaacaggcttctcagaagattgtatccagtggatcgaattttataagagctgtgagcaaaggtggagtaaaaggcggtcttagttacatcggaaatggtgctaagaaagtatatagttctttcaaatcctatgcatcagaaaaaacaaaagaaattcgccagacaattaaaagagaaatgtgtactacgacaaatagaatttcttcagcttttggaaaagttgattggaatgtcgtaaagaaagtagtagcaggtggagcaatcttagctggtcttggaattgcaacaatagtaacaggtggagcagcaggagtgattgcggccggagcattcagtggagctttgattggcggtggaactggagctgttcttggtggtttatctagtgctgcaaatggtgatggatttattcaaggtgcagctgatggattcttgtggggaacaattggtggagccgtatcaggtggtgttggagcagcaacaggttcacttgcaagttcatctgcatcgtcaatcatgaaaaatccattagctaagagtgcacttgaaaatgcggcagatacagcagttggaacaattgacgatttagcgcatggtagagatgtatctataggttccatagctatggattttggaactgggatggtatcatcgaatattgatttgaaaaaggcatctcataccacttcagttattgaagacacaacaaaacatagtgtcaaaccagattttattgtaggaacaaatgggactacggtatctaaagaagtatatgatatgtcaaatgcagaatttgttcaagaagttgcaaacatatcgaataaaaaagttaatgaggagttgacacaggaaggaaaatcagtatacggtcatgtggcaggttcaaaaaaacatagtgaagcctataggatagcaagtgattatcaagaatttgtagatgatcgaggtttgaagctggaacagccttataaagataatgaaagcaaaacaagaaatgaaaaagaaggcgtaaggctagacgtttacgatacaaatgatggacaagtatatgattataagtttgtaaagaatccggggaaaggactatcaaataggcaaaagaacaaaatcattcgcgaaggcccagatggattaacggaaaatgacattcatgaagtaaatccgaaataattaaacaggaagcaatatttgacgatattgcttccgctaaagagaaaaggggataaaagatggtaacaaaaaaacagataacaaatgattgggagcaactttttccagaattaaaaaagactcgattacttgaaatggataatagattgggtccattgataacaggaatctatctaaaagtaattagaaatacatattacacaccggttttttatgtacataatttatgcagagaatattctagcattacaacatcattagagtgtactagtgaaacaatagagttagaaaaacatgaagaacgttatatgttttcagcagaaaggttaaaaaataaattgttgattccacttaaaggcgatgtctcaatagataaaattatagaaggctataagttctttttaagtaatccaagaagaaaatcatttgaagaatataaagatattgctctggtttgtggatggtatggagaaaagaaaatacttgacgatatcctcgaatatatttggaataatgtgcaaaaggataaaaatcatcctttttttagaaataaagatagaggagtagaaggatggtttgaaaaaatttgcgaggactcaaatgattatgagagacttcatgaaatatgtgagagagaaatacaaaaacataaagtagaaaagttgccatatagaaacattatttaaactcaggtatataagaaaatgcaagtagaagaatgtgtaaaaaaattaaaaagcaaaggtattattgattccagagaaatatatatatatgcatcattaaaaaatataataggtggaatgtttggaagcataagaggattagttttgttatgcatatatgaggatgttttatatatttatcgagccaatattgataattcttatggcgaacgattagcgaaaatttatattccaaatatgaaaaatatccaagggaaagccggattatttggtggaaagttttctttcaattatgaagggcaagaatataaatttaaattgccatcaaaagctggaaaatttgtggattttttcgtaaagtaaaagtatgaggatagataccaaaatgaaaaaattacaaaaatatataatgattttggagacagtattgttatgtactggatttagtgcttgttcaaaacaaccagacttcgatgccaaatcctacgtccaaagttctcttgatgcatactatcatggagaatataaggactatgcgaatctgttagaaatctcggaaaaagatgccaagaaagaaatcgaagaggattttaatgagagcatccaacagcaatttgatgattccgataacattacagacaaaggaattgctgattatgcggaaaaactgacagaagtaaagaaactggcaaaatataaagtacaggatgtgaaagaagaggatggagtctatacagtaagtgtacaagttgaaccatccaatgtatttcagacattgcaacaaagctctacagaggtaagcaatgaaaaaataaagcagggactggatggaaatgatccggaagtctttgcagctgtattaacagaaagtgtccagaagagtcttgaaaagaacagttatgggaaagctgttactgtaaaagtatccgtggaaaaagataattcaggaaaatatggtctttcggatacagagatgagtaagctggaagcagcaatgtttccaacagaataagaaggaatggaaagctatcagaagaaaaaactggtagctttcttttaaactccaagacaagaaaatttgttaaaaaagctattgtaatagtagaaaaattataataagtaatggatgacaagagacttttattcattatgaggaaaagaaggaatctcctatgaaccaacaagaaatattcacataagagagaaaaaagtgctgtaatcgaagaggttgcagcatttttttctttgatatttttcaaacattataacgtacatatccggtcaccgccatgctccgatttgatctctatacgaaaaatcagatcggaggaaagataaatggcttataacaagacaagtgaagaacgaaagtggaattattggaaaaaacaggaagaaaagaaactgcgtgaactgggaatggaagaagagaagatccgaaagttgcgccagatggacagggaagattttctggaagagcgcagataccgggaacatctggatgaaatgatgcaggatatggattccataaaacaaagggacagaggacggtttgcacaggacatccgagaacttttagacaacattggagaccgacggatctatgaattattaaagggcacagaacatcagatattagagatacttttgcttagtacatggggatattcaggaagagagattgcccaaattatgggaatggcagaacagaccgtttataccaaaagaaaccgtttaagaaataaattaaaaaatttgttgaaaattgaataataacagcatttttcgtcggctatttaataggcaggtaaattttgccagtgtactttgacaatcctataccagcattacaggtacgttcccgtaagtagaagcgtgtcaggaaggcgcgaggacagatgaaaatgacaggaaagaatataaaaaaattctttgctggtgtttttgtttcgagcgaatcacctttaactgaaacaggaccgtggcggtcttttgcgaggatcacttacgaggggataatgatacataggaactgccagtgagcagaggatggactttgggttgtaatcagcaagacctttagaaaatccatgagcggtgcaatgccaagcatccgcctgtaatgttcccgtaaggcagtggggggagtcgaggacaaatacaacgccaaaaaacaaaagtataagaaatcaaggaagaatgtgtcgttgatatcagatacatgcggctgtagggagtaatcctttacagccgtattgatgtggtatcagcacgcatatcaggtaacaaattatgtattacacaaaagaatatttaaaaagagcacatcgtgaaattgatacaatctttcgtgtgctgttcccggaacatggaatggcagtaagggaagaacagattatgttatgccacgaaatgctggataacctgctgggaagaaacatagcactgtgtgacgcaggtgtcggtatcggcaagacgtatgcttatctggtggcctgtgttctgatgagaaaatattccctccttgcagaaggatgttccccttatgagcagcgtccggtcgtgatatccacttccagcattgcactccagaaagcaattcttacagaatatatcccttttctctcccggattcttcaggagaacgggacgattcaggcccccattaaagctgtgatacgaaaagggaaagagcattttgtctgcgatgagaggttggagcaacgaatcgttgcaatcgaagagaaaaacaaaaatgcgttgcagaaagaagctctgctgtcgttgaaagaacattatgatatggacgaagtgtccaacttaagtgggtttgacagaaggatggtgagtgtaccgaagttctgttcgggagactgcccgaaaagaggttcgtgcaggtatcagcagtatctggagcgttccagagataatgaaatgttcattcagatctgtaatcacaattatctgctggctgatggttatcacagactgcaggattaccgcccgttattgaaagattacagggcattgattgtagatgaagcacacaaactgccggatgcggcaaagcagatgttcgggaagagcctgtgttatgacgatatccgggaaatatgcttttatctagggaaagagtaccaaggaccggagataaggaaattgtccggcacgatccggatggtgctggacattataggagaaaaccacagaaccagatatgggataaaagaagaatttcacatgacagaagagtgtgcaatgtatttatatgaggggatacagaccatgaataagatcatagaaaaattagaaaagaagattccaaagtggatcagaaacaagctggaagaaaccagaagtgtgctggaatgctttttccatcaggataaaaagtatgtgctgcatctgaagcaggaccatgaccaccggattatattgtgtgcatccagcagacggattccgcagtacctggaccagatgttatggagcagaggtatgggagcgattcttacaagcggaactttaaaaaccggacagggattttcccacattcggaaaatgacaggattacagaggatgcggagagtccgggaatatgtggcagactccccgtttgaatatcagaagaactgtctgttatatctgcccaagaatttgaaaaaatacagaagaggaagtcaggaagaggcagagatgatagcaggtcatattcattcgctgatctgttcgacttacggacatacgctggtgctgttcacatcttatcatttgatgggaaacatttaccagatgttaagggatgaaattccattcccgatgatagaggtgtggagacattccccggaagagatcacaagatttaaacagatggacaatgctgtcctttttgcagctggctcctgctgggaaggagtagacttccccggagatatggtatcttcgctgatcattgtaagactgcccttcgctgttccagatcccatcagcgaagcacagaagaaggaatatgccggtctgaaagattatattcaggcagtgattgttccagacatgcagaaaaaactaagacagggattcggacgggcgctccgcaccgagacagatacttgtgtcgtgtccattttagacgagcgtgcaggagaaggcggcaggtatcatgaggaagtgatgtgtgcgcttccaagctgcaagatggcaaaagacatcaaggatatccagcactttatccgaaaccggaaaggcgtggaatactacctgtaaccgttcgtggttctgctacaggaaaagcagattttgcacgaaaagtttggtggtatttcaagggcgttttcggtgggattgttggtattgatgaatagctatttcggcatgaagtgggtatactgtgtatagcgttagaggaaaggaggcagcttatgatatacaaggtggaaacgataaaagatggaacagaaaaatattttttcatcagaaatctggaaacaatgagtattgaagaactgccaagtaaatatctaatgcataagattaaatgtaaacgttcaccaaatacagtgaaacgcacagcattttcaatctgctattatatgaaatatatggcagagaaagaaatggaactcacagaagtctatcagttagattatgaaaaacagacagaacactttgtggaatttttatactggcttaaagccggaaaccatacagagcaaacggctggagaaaagaagtgtccgaatgaaggaacctgcaacgcatacttaaaagatgtgttcaggttctatttatttatagaggcagaatatgaacagtacggaagtctcaaaaccttatcgtataaccagattatagcggttaatcaggtgggagtaaaaaaggtactgcggaatcattcttttaaagcctatctgaaggaagaggaacatcgtgggagaacagcaaaagaaaatcagattattacaattttacaggcctgtacgaaccgaagagatcagcttctgttacttatgttagcagaaaccggatacagaattggggaactactgggagtaaaatatgtcaaagatattgattataggaatcacatgataagggtatgcttccgggaagataatgaaaatgaagcgagagccaaaaatgcggaatacagaagtgccaagataagtaatgatacgtttgaatttctcatggattatctggcaaaatatcggaaaatcctgcaacatcaggattacctgtttgtgaatatcatgggtgagaacattggaaagccattaagagtggacagtgtatatgatatgttggaccgaatggaaaagaaaaccggagttaaaatcacaccccacatgttacgtcactattttgcaaatatgcgaaagcaggcaggatgggaactggaaatgatcagtcaggcattggggcataaacatttggatacgactataaagtatctggactggctggatgatgaactgatagaagcaagtaatgagttttatgcacaacacactgctatttatggggcggaacgtctgctggagtagggaggtgtgagaaatacctatatatttattgcaacaggcagaacacataacagaatctgaagtagatattgagaagaaaaagcaggaactatattcagaaattgatgcacttggaataaaaagcgattcaagaattaacaaattgaaaaagttcttggcagatagaaaaatctggcatctggaagaaatggattatcctttgcgaaattcgtatgaacaatatttaagaggacagatacgatcacaaattgtatctttctatttgaaaatatatgatacggtaaaacaacaacatatctatcaacagatgcagacgctaaatggaaagcggatatatgaatggaaatatcaaaataaaatttattttctgaagtattatccggaaaaggaaatagctgagacctttgaaacttcttataaaacaaacctattggtgtgggattttacacaaaattgttcagaagttttaaagaaacaaattttttatacgttgagtcgtatcattgcaaatacttcaatgtctaaggcttatagaaatgtcaggttaaaatccttaaaacttctttatgattcttgtgttcagttaaatattacggatattggattgctggaaatggaacaagtggaaactattttaaagaattttcccgaaacgagtcaacgaagtattttaggtgaatgcagaagagatgcgtttatgcagcaggaacagatccaatgggaagcaaatgtatggtatctggaacgattacatcttggaaaacatcggatagacgaaagtaaatccttaattagcatttcttttatggaaatcaaggaaatacagaatcgagaaattttacaggcatacatgaaatatgaactgggaattactggacaggcagtcagcacgattgtacgaagatttgtatgtattagaaattttattgaactgctggaacaagaaaagatactggcgattcatgcaactgtcgcagaagtaaaaaagtatgcagacggcttgcgagaacggggaatgcaggcaaagggatttaatgaaagaattttcggtatcggtcatttttataaattcatggaagttaaacagtatattacaagaatgccattccgaattgaatatttccaacaaaaagaagtagtagtacatcatgatcgtagcgttgaggaaacagtatatatggaaattttgaaaaaattatatctttttccagagcgattacgatgtatgttcctacatctgtggtgtctaggattacgggcgagtgaagtgtgtacattgaaaggaaatgcttattatcagcagggcgaggattattggattcaggtgtatcaggtcaaaatgaagaattataaaaggattccaatcccacaggcactttatcagattatgaaagtatacttgaaaaaacatgaaattcagcctgaagaattcatttttaaaaacaacagaggtggtgcttgtctatatggcacattccgaactcagatgatagaagcgtgccgggaaaataagattgcaaatggagaatatttatttcaatcacacgattatcgacatacagtagcaactatgttttatgacagtcatgtatcactgcaaagtatcagggattatcttggacatacttatgaagagatgacaagacagtatattgattatatgccacaaaggattgcaaaagcaaatgatgagttctttgaaatgcaaggaagtagtttagcatcatggctaaagaaagaggaaaaagatggaaaatgatattatatacttcagcgatttccccaatttacaagaaacagggacacgtaaggataatggaaaatttgatttaacgttgcttccaacgcaagaattaaaggaagagtttcgaggttatattatgtatcgctgcaaaaacggaacgtttagagcattgattcaggatcgaacagcttataatcatattgcaaagtttttgaacagcagaataaatcggagaatcaaaagccttggagatagaaatccagaaaaatggatatcacttttaaaaggctggatgttagaacagggaataactattgtaaaagaaaagaagagtgtgtatggtacagtaagctatggcgaagcagtgacgatattatatttcagaaacgtactgaaatttttagagccagaagatttacgggatgagatagaaaaagatgtttgggaactaaaaaatctggatattaaaatcagatccaatccaatttataatgtaaaaacactggatttcagaaaaatatatcagccagatatccgggaagaatgtaagaaagctgtttatatgaatctacagtatgaagcaataggaactgtacagggagaactgacaataatgaggatattctcagaatatctccaaaaagagtattccaaaataaaaagttgcagtgaaatagacagagaagtgctggaagaatttttgatacatctgtcaacaaaagatacttcccatagtgcgaatagttcttatgtaatttcattaagacgacagttagagacaatcggaaaaatttacagctatgaaagattggagcatttatttattaatacggatattccaccggaagtaaatgcagaatttagagtgtattctgatgatgaaatgaaacgactgaatgcggaaattacacagatggatgtacagattgcaagatgtcttctgatacatcagatgcttggaactaggatatcagatacccttacactgagaccagattgtctgacgagagaaaatggccaagatatgattgaaatatatcaagttaaaactaaaagatataaaaaaccgatcagtaaagaacttgcaaaactgttacagagttctattgaatatacacaggaaaagttcggtgatacagaatacatatttgttaatgaaaaagaacctgaccgcccgatgcagtatatggctataaaaacaaaagtcatgtccatgatacaggaaaagcagttgaaagatgatcatggcgaattattcgggtttggaacgcacatgttccggcactactatggcgtcaaacttacagaaatgcatctggatgactggacgatagcgagactattggggcataaaagactgaataatgtacagcattaccggaaaatgagcaatcaaagaatggcagacgaaaccagagaagtaagacagatgatgagtgacatcatatatatgagtctggcaggatggggtgaagaatatgagcaaatacgacaagatgattgaggaaaatcagagaaaaagtaaagagaaaattgaactggcattgcaagcaatacaagatatgctggcaaataaagaacgtatcagtgttccaaagctgatgaagaaaaccggattgtcgagaggattcttttataaaaatccaaccgtccgagatacattgaaccaagcagtagagcaacaggccggaatgatagatccaagaagagaaattctgaacatggcgatggaaaaacagattgaactgctgaaccagaaggtagcagctctaaccagagaaaataaggaactgaagagaaagaacgaaaagttacagaaggcattatggaaacaggatttgaattttattaagaacttataacattgaaaataatgagatggaagagatgtgtgtagacacatcttttcatcgttgaggataaaacatatagaatgagaatgggattgttttatggtatactaaaagtgaaatgctaactttgatatgaggtataaaacaatatgacagaaatacaaattaaaaatttaattaaagaatatgaaaaagaatatattgagtttatggaaattgagaaattaccacagtataagatagatttttttgaaattaatgttgaggaaagcgatgcagcaggattcgcttcagccgcccaagcttactataatacgaaaacagatgaacatatattaaggatatgcaaaagttcggaaataccaaggtatattgtgtttcatgaatttacgcatattttagatacggaaatgtatgcaaagcaagattcttggaaatatatggctttgtctggttatacagaatatcatgcagcacaagttgaattgatgataatgttaggagcagatagtatacaaactcaagatttttcatttacagttgatgttgaaataggtaatagtacagttaggaattacctaaactcaagacatcaattagtagtgaatatgatgaatagaacagattttccaagagatattgaagcattaaaaacaacggtaggtgtgctatataattattttggagtgcgttctatatgtaaaatgtatacgaaagattatactgaagaagtggataacacaattattattcagaaactttcaaaagtattatttgaagagataaatagctttatggttggatggtttaatgaagcacaagtagagctgagctttgtgtcatatatgaaaataatgtggcctatgcttcaaagctattttggaaaagaatgaaagatagtaacagtaaacacagttttgtatacagttaaacccagtaaaatcaacgcatgaggggaactggctacattttactatccgatctggtggtatgtggctccgacaatcatcaatacatttttagaagcttatgatttcagtggtaaaaagattgtgctttttgcaacatccggaggaagtggatttgggaacactgtgaaagaattgcagtcatctgcaccagacgcaattattacagaaggcagactgttaaatcgtggaacaaaacaggaaatctgtgaatgggtaaactctttataaataacagcgttatggaggtatatagaatatgggaaaaatagtacagacagcaggaagaaatacacttggtgaattcgcaccggaatttgcacattttaacgatgatgtacttttcggcgaaaactggaataaccaggatatcgacgtaaaaacaagaagtattatcacagtggttgcgctgatggcttccggaattacggattcttctttaaaatatcatcttcaaaatgcaaaaaatcatggtgtgacacaaaaagagattgctgctgtgatcacacatgttgcattctatgcaggatggccaaaagcatgggctgttttcaatcttgcaaaggaagtgtgggaagcaggcgaaagagatttgccatacgaagaggaagcgatgcgtgcgcatgctaaagagatggcatttccaatcggtgcaccaaacgatggctttgcacagtatttttccggcagaagttttcttgcaccgatctctacttctcaggttggaattttcaatgtgacatttgaaccaggatgcagaaataactggcatatccatcatgcaaaaagtggaggcggacagatcctggtatgtgttgccggaagaggatattatcaggaggaaggcaaagacgctgtagaaatgaagccaggtgactgcatcaatattcctacaggtgttaagcactggcatggagccgcaccggatgaatggttttcacatctggcaatagaagtgccgggcgaaaatagttccaatgaatggcttgaaccggtaagtgatgaagaatatagaaaactaaaataggaaggttgaaaaaagtatatttataagacaatttgcatatggaggttatatttatgttgaaaacagaagaattaaaactagtatctgaatgggataaaacttttccaaaaagtgaaaaagtagatcatgagaaagtgacatttgcaaatcgttatggaatcacacttgctgcagatttgtataagccgaaaaatgcatctgggaaatatccagcgattgctgtaagtggaccatttggtgcagtcaaagaacagtgttccggactgtatgcgcagacgatggctgaaaaaggataccttactattgcatttgatccttcttttacgggagaaagtggaggcaatccaagatacatggcttctccggatattaatacagaagatttcatggctgctgttgatttcctttctgttcgggaagaggtagatcaagatagaataggaatcattggaatctgtggctggggtggaatggctcttaacgcagctgcactcgatacaagaataaaagcaacggttgcatctaccatgtatgatatgacaagggtaaatgcgaatgggtactttgattctgaggacagtgaagaagcacgttatgcgaagaagcagtcgctgaataccctcagaacacaagaatactgtaaaggcgaatattccagagctggtggttgtgtttctcttccggttccagaggatgcccctttctttgtaaaagattacagtgagtattataaaggcagatgttatcataaaagaagcctgaattccaatgatggctggaacagtattggatgtatgtcatttatgaatcagccaatattaaagtacagtaatgaaatcagaagtgcagtcctcattgttcacggagaaaaagcacacagctattattttggaaaagatgcttatgaaaatatgattaaggacagcaagtacacatccaataaagagctgctaacaattccaggggctgttcatacagatctttacgataatctggatgtaatcccatttgataaaatccagaaattttttgaagaaaatggagttggttaattatggtaaaaaaagtattgatcatatcgacaagtcttcgaggagggagcaattctgatatacttgcaaatgagtgtgcaaagggagcaaaagaagcggggcatgatgtggaacttctttctttgaaaggaaaagatataaaatattgtatcggttgtctagcctgccagaggactgggatgtgtgtacagaaggatgatattgcagatattatggcaaaggtaaagaatgcagaagttattgtctatgcaaccccaatttattattatgagatgtgcggtcagatgaaaacacttcttgatagattgaatcctttatattcggcagattatttattcagagatatttatatgattgcaactgcggcagagaatgaggaaagtgcatttgagaaagcctataatgggctgcaaggctgggtagattgttttgaaaaggcttccttaagaggcatggtcggtggcggtggaattgatgcagcaaatacagctgaggatcatgtggatataatgaagaaggcatatgaacttggaaaaaatttataagttgataaaataattctaattattaaaactaatagtaactcaatattatcaatagcaaagctataagttttcaaaaaatggagtcttatagctatttttttgcgcaaaaataaaaaaatttctccaacaccctgtaaaaacaccgttcttcttttgtatatgtgagagataaaaacaaaaaaataaaattttttgtttttgcccactgtattttaccctctgagcgtttcgttatatgagggcgtaaaaaagaaagtctgatgcagtggtaataaattgtttttgtgctctcaattgaatccaggcctgattcatatggaacaagtaaatcagaacaaaaaaaggaggaagatgcgatgaacaaagtgattttaatgggacggcttataaaagctccggagatcaaatatttgcaggatgataacaaaactgcaatggcgcgatatacgttagcggttgaccggaggtatggaaaagactgggaaagggaagcagattttattccctgcgtgacattcggaaagaatgcagagtttgcagaactctatttgaaaaaaggaaccaagatcgtcatcagcggacgaatccgcacaggaagttatacggacagcgaaggagtgaaaagatatagcagcaatgttgttgtagaagaacatttttttgctgaaagcaagaaagcatccgatacggatccaaaggatgagaaagatggatttatgagtgtgccggaagaagcagagttgccgtttgagtagacagatctctggagcttaagcggaaaagcgcacttatatactttagcaagtatgtgcgtcctccggaaggatacttctttctgaaagctattccaaaagaagttttcggattgcatccgatgaaggggtatcccttccggcatagatgcctaacccataaaaagaaaacatgaaaatagaaataaaaggaggaagttgattatggcaaaaaaagaaaattttcaggaatatgtagtacgtacacaaaatgaaatcgcagggactggatttttaaagatcagcagaggcgtgaacgtctggtaaaggtgtacaatgaacgatttaacagcatccgtccccgtgaatacgatggcagtcatttgacttttccaggaatgaatccggaaatagaacttcgcccacatcagaaaaacgctgccgcacaccagctttatggtgacaatgtacttctggcacacgtagtaggagctgggaatacctatgaaatggtagcggcggcaatggaaagtaaaagactgggattatcacagaagaatctctttgtcgtgccaaaccatttgacggagcagtggggagctgagttcctgcagctatatccgggtgccaatattctggttgcaaccaagaaagattttgaaccagcaaaccgaaaaaaattctgtgctagaattgctatgggcaactatgatgctattatcatcggtcattcccagtttgagcgtatcccaatctctgatgagcggcaggaagatatgctgcggaagcagattgatgatctggaaatggcaatccagagtgcaaggtatgaacaggacggtggacgttatactgtcaaacagattgaaaagaccagaaaaacactgcagacaagactggaaaaactgaatcagaaagagaaaaaagatcaggtagttacgtttgaagaactgggcgtggatcatttgtatgtagatgaagcacacagctataaaaatgcgtttctctacacaaaaatgagaaatgtagccgggattgcacagaacgaagcacagaagtcagcagatatgttcaataaatgtcagtatctggatgagattacctgagggaaaggcattacctttgctacaggcacaccaatcagcaacagcatgacggaattatatgttatgcagcggtatctgcagaacagcaaactgcagaatatgggacttggattgtttgattcctgggcttccacttttggagaagttgtcacgagcatcgaacttgcaccggagggctatgctttaataggacgataaagttaactgtcctaaattgaaaatacataaggaaggaggttaagagaatgtcaaggacttcaaagattacagcactttatgagagattatcaagagatgatgacctgaatggcgagagtaattccattaccaatcagaaaaaatacctcgaagattatgcccgtaggaatggttttgagaatatccgccattttactgacgatggtttttcgggtgtaaatttcaatcgccccggctttcaagcgttgattaaggaaattgaagcaggcaatgtcggaacattctaagcagacgcttgttgttgaccctgtggcttctgaggtggtaaagcgtatctttctgcttgcaaatgagggcaaaagtccacgagccatagcggaaatactgaccgaagaaaaggttttaattcctgccgcatatgcaaaggaatatcacccagaacagtacaatgggattaagtttgcagacccttatatttggggcatatctgccattagaacgattttaagcagacaagaatatcttggacatactgttttgagaaagtcggtcagcaccaattttaaattgcataagagaaagactaccgatgaagatgagcagtatgtgttttataacacccacgagcctatcatatcgcaggaactttgggacagcgttcagaagcgaaagaaacgagtgaacagagctgcggcaagaggtacacataccaaccgattaagcggttatctgtactgtgccgactgtggcagaagattgaccttgcagacacattacagcaaaaaagaccgctccttgcagtattcgtaccgttgcggtggttatgcgagcagggtaaattcctgtactgctcattcaataagtgctgataatgttgaagccttgatattatcggcagttaaacgcttttcaaaattcgttctgaatgacgaaaaagcctttgctttggaactgcaatccctttggaaagacaagcaggaggaaaagccgaagcacaatcaatcggagttgaaacgctgtcagaaacgctatgacgaactctctacgctcattcgtggcttgtatgaaaatcttatatcgggattgttacccgaaagacaatacaagcaactgatgaatcagtatgacgatgaacaggctgaattggaagcgaaaatagaaacgatgaaaaaggaactttccgaagaaaaagacagcactatggatattcagcattttgtttcgctgatacgcaaatataaaaatcctacggaagtttccgatttgatgtttaccgaactcattgacaagattgtggtgtatgaatacgagggtgtaggtaaagcaagaacgcaaaaggttgacatttatttcaattatgtcggacaagtcgatattgcctacaccgaggaaaaacttgccgagataaaagagcaggaagaacaggaagaaaagaagcgattggagaaacagcgtcagcgtgaaaaagcctatcgagagaagcgaaaggcgaaaaaacttgctgaaaacggtggcgaaatcgtcaaaacaaaggtatgtcctcattgccagacagagtttgtccctacaagcaatcgacaggtattctgttcaaaggattgttgttatcaggcaaggcaggataagacgaaagccgacagagaagcggaaaaaggcgatcactattaccgtcagcgtgtatgtgctgtgtgtggtagtacctactggcctacacacagtcagcagaaattctgctccgaggaatgtaaaaaggtaaaccacaacaagaaaaccttggatttttaccacaagaagcaaaaggaggaagcactatgcaaagatttattacagacgaaagagcaggtatccgatacgaactcatcggagattactattatccctgcctgacagtagaggaaagtcctcccctttcaaaatatggacggttgcggcaacgatatttgggggaacataagcgtgtgctatattttaatctgctgacaagcagaaagttatatgaacaccttgccgaaattgatacttcggctcgtgatatggcggaatatctgataaaggaaatggcaaagaagcagggtgtaacggaagaactgaaagcaacggatatgatgagatggataggattgatgaataacattcgagcctgtgccgatgagattgtattgaatgatattgtgtattcctaacggataccaaccgaagaagaactgctgtcaaaccaatggcagtttttctttttcggcaagtattcaagaagtcattaagtcgtgagtataatcgaagtggtagaaaagttacctattatatcggttgtaacttttttatgaactctattgacaagaaaacttggcatgtgtataattaaaatatgcaaagaaaacttggtatggaggtgttttgatgaaaaaggacgaaatcttaaatgcaagcagaaaagaacatcgcaataaggacttggctgaaatggaagtggtatatcaatccggaagtcacgcaagcagagttggtgctttagtgtgttgtttgctttcgctgttatcttctgtgcttgctcatactatgatttacagtccgtgggttatatacttcagcattattgcaacacaatggttagttcgttttatcaaaatgaagcgaaagagtgatttggtcttgaccgttctgttttttgtgttttccattttggcatttgttggatttgttagccaccttttagaggtgagaatatgaaagaacaattacaactgaaaaatcacttaaaggaagttcgcacagaagcaaatctttctcaagctcagcttgcagaaatggtaggagtatcaagaaataccattagttctattgaaacaggacagtttaatccaactgcaaaattggctctaattctttgtattgcattggacaaaaaatttgaggaactattctatttttaggaggtcattatggaaaatattataatgttgattttgggagtgttcatatctgttgtgggaattgtaaatatcaaaggcaatatcagcacaattcactcttataacaggcgaaaagtaaaggaagaagatataccaaagtatggaaaaacagtcggcacaggaacgctgattataggaatatctcttgtattaggttttattgtttcgttttggagtgaaataattatagattatatcattcttccagcagttattgtcggattaggctttatattgtatggacagttcaaatacaataaaggaattttttgagaatcagggaggtataaagatggaattgaacacaatatcaggtctggcgatagcgggagttatctgctccgttgtcctctcgatgggggtaccgattgctttgttcattgcaggaagggtgaagcttaaggcaaggatttcctcgttctttatcggagcaggaacctatctgctgtttgccatgctgttggagcagctgctgcatgttcttgtcattcagttctgcggactgaacgcacagagcaggccatggctttactatgtgtacgcggctttggctgcagcggtttttgaagagaccggaagactgattgccatgaagttctggatgaagaaatggctggattttccaaatgcactgatgtatggaatcgggcatggcggtgtggaggccattctgctcggaggactctccggaatcagcaatcttgtgtccatgctgatgatcaacagcggagccatgcagaatacgctggcggcacttcctgctgagtctgcaaaccagaccgtgtcacagctgtcggccctatggacaacaccggcaccactcttttttgtaagcggaatcgaaagaatcagtgccatcattctgcatatcgggttgtcactgctgatctaccgggcggtaaaggcaggcaaatgcaggacagcggcttttacagcggttcttgcatatgggattcattttatcgtggacttctttgccgtggcaggtccggcgcttcttcccatctatgtgattgaaattggtgtctttgtgatggcagccggaactcttgttatggcgctgaagatgggaaggatggaagaactgtgaattccagttttctgctatcataaaacagaatatatctgacagaacgcaccgtagaaatacggtgttttttgttaccccaaacccacaatttcatacacaaccacaggttagtacaaataccttatgtgcgtttttgaaaggcttagaaagggatatttaccccgattttcgccccgagaaatgacacaaataaggctgaatgtatcttctctgtggtttttatattttcggcaggaaaggaggattgcttgctatgccgagaatgagcaagaagcggaaacaagagtgggcgttgtttctgaatgatcgaaaccgcattacctacaacgaactttgcagaaaatgcaggaatgactgtaagcagagtttccgctgtattgtggtgctttgcccgaaatatttatcgaaaaggagaacaaagaaaaatgattgaaaatgaaatgactgtcagcgtgcctcttgaagttgtcaaggcgagtgaaatcgagccgaaagaagtgaaatggctatggtatccatatattccggttggcaaggttacgctgttgcagggcgatcccggcgatggaaaaagcaagctaatgctttccattgccgccctgctctcaaagggcgaacctctgccctttaccgaaacggaagaaaacgagcctatgactatcatctatcagacaacggaagatgacgccgatgatacggtagtccctcgcttcaattcggctggtgggaacggagaaaacctcatcttcatcaaggaagatgaaaaatctttgtcctttggggataaccgtattcgtgaagcgattgagatgtaccacgcaaaacttttaattcttgacccgatgagttcctatatcggagaaagttgttcgatgaacaatgccaacgaaacacgagccgagtttaatcatctgatagcggttgcgaaagatacaggctgtgcgattgtgattattgctcatatgaacaagatgagagataccaatcccctttaccgtactaacggttcgattgacattgcgggtgctgcaagaagtattcttgcaatcacacgcacaccgaacaaggaagtacctgcggaaagatatttggtgcaggtaaaatccaaccttgccccgacaggctctgccattctgtttgaagtatctgagaaaggtgtggactttatttccgaaatggaaatgacagcggaagaagcgttccaatccctcgccccgaaaatcggcagacccaacgataaggaagtcaaggcgaaagcatttctgattgaaatgctgaaagacggagaaatgctttcttcgaattgtgaagaaaaacttgaagccgcagggttcaggaaatcgaccattaaaaaggcaaagaagaacgcaggagttatctcccgaaagaaaggttttctgtggtactggtctttgccgatgagcgatataccgagagaataaatgtaggctgtctgctgatgggacagtctgtttttatgattgaggtatcaaaggaggtcaagggggaacacccttgcccacgacatctttgcagacgaagtctgaaagtgtcatagtgggttacacacattcaaagaatgttgtgtaatggcttcgccctgccgagaaaggagaacaaaaatggcgaaaaacaacaaggcggatatgagttgtgcaagggttaaaaagtacaccgcttctgatgtgagcaaggcagaaagacacaacgaacgcaagaatgaaacctatgaaaatatgaaagtgattgaggaacgcataccttataatgtgcatttcaaaaagccttttactccgacctatatggagcaattaaagcagatggaagctgacggtatggtgtcgcttcgtggattgagaaaagacgcaacgctctttaacgagattgtgattgatgtgaacacgatgtacttcgagcgtaacggtggctacgaatatgcaaagcagttttatgaggaagcgttccatttcattgaggaaaaattcggtgctgaaaatgtaatatcggcagtaatgcacgatgatgaaatcaatatagcggcaaccgaggaacttgggaaaaaggtgtaccactatcatcttcatgctatggttctgcctgtggtggagaaagaaatcctatggagcaagcgttgcaaagatgaaaaactgcgaggaacggttaaggaagtagtcaatcagattagccattcaaagaaatggaaatcggatattccgctgaccgatgaaaaaggaaatccacttcttagaaaaaatgggaaaccgatgttccgagcttcatacagcatactgcaagacgaattgtttaattatatgacggagcgaggattcaaaggctttcagcgtggcgaatatggaagtaccgccgaacatcttacttccctacaatatcaaatcaagcaggacaaggaacgattggagaagttgcagaagcgtattcagcgtgaacagatgaagtatgagcctgcccgtaatgtttccaaaacctataacgagattgacagtatggggcagaaaacaatcacgggtaaaatggcaatctccaaagaggattattctcaactgactgcccttgccaaagagggcattaccagtcgtgcagaaatcagcgaattagaacagaatgcaaactattaccgacagaaatattttgactgtgcaaacgcactcgaaagaatgaaaactaaatacaacgaactgaaagaaaagtgcggaccttttcttcaagcgttggagcatttccccgaagttgctaaactttttaccgaaaaagtgaagcaacttttttcttttaaggaagcgcaggaacgagccgaaaaagaagcaagggaaaaagaacgacaggagcgtatcaaggctcgcaggagtaagcgtggtatggaaagataaccttttccattatactcacgacttaataacttcttgaactattgaaaatctgcggttattgggtgttccaatatgaatgccccacaatcaaatcttatgaaagagaggagcggactatatgaaagaacagaaacattcttattcgcaacgcataggaaaaacaacattcatcgtaaatgtaaagcagtccgaaagtgccaaaaagcctttgaatacggtgtttcaagacatctgcaagcacgaggttttgggcgatttctttacggacaaatcatttaatttagaaaatccacaaaaagtatcttgacaaactcgaccccgaaggaacaggatatcgagcaaaatcaagattcgccagattctataatatcccggaactgatgaatatgtttaagaaaattgctgatattaagacttccgatcaattaaaactccctgtgccggaagcagaatatgaaactgtagtattgaagccaaccgatcagcagaaagagattgtagaaagtcttggtgaacgtgcagaagtagtaaggaatggcggtgtggatgcaagtgtggataacatgctgagaattaccaatgatggtagaaaacttgcattagatcagcgactggtcaatgatttactgccggatgatccaggaagtaaagtatctatttgtgcagaaaagagttatgaaatttggaaagacacagcagcacagaaatcagcacagttgattttctgtgatttgagcacaccgaaaggcgatggcagtttcaatgtttatgatgacttgaagaagaaactgatggagaaaggtgtacctgaaaaagagattgcttttattcatgatgcaaatacagaaggtatcattgaccaggaagaagcattgaaattatacgatgtcggagcagatatctatctgaacactaatttttcgtcaccaatctatgtcacggaacgcatggaaatcgaacgaggaccggagcattatcagatgtccatggcagaacgggagcgtttccgtaacctggaatgggaaatgcagaaatatccacagattcagtctttgaaagaggcaaacttgttgttaggaacaaggcgaacctttggtatttatcagatcaaggacgattcaccgggcgaaaactatgcatttatgaatatgagttttattgaaagtcatggtatgcagataaaaaaagaagattataagctggtctatgttggcgaattactgggaaatatgtcactggatgatatttttgaaagatttaatattgatagaccgaaagatttccgtgggcattccctgtcagtcagtgatatcgtagttctgaatgatggggaaaaagtaacagctcattttgtagacagtatcagttttgaacagctagattctttcctgaatctggaagaacaggttcttagtgaactggcatatgaggtaggagaacgttactttgctattcagagaacagaagaaggatatgattattccttttacgatgaagatttccgcctgatggatagtggcgtctatgaaaatgatgaaatttctattgaagaagcggcagaggaacttctggaagacgaaggctggactggagaacgcatccgtggggattatgatcagttgatggaaaaagtggaagaaatggatgaggttgtaatggcagagattcagaaaagccagggcgaatataagcctttggcaaaggtggaggaactggaagaggcgaattataacatgattgataacgtcctcaacaatatgccaccgaagaaagagccttatctggaatactttgccacagaatgcgatgagttccatgacatgggagcttatgaaaaaagtacagatgttaatcagatagctgcagtctataaaaaatatagggagaatccagaaactgcgtatctgggatgctcgatgggaattatctatcgtgatccggaagaccgttactacgatgatgctgaatttgcaatcgtaaaaggaaatacagtacttggaaatctgatggatgatgttcggttttatggagaacttgcactggtacgggaagggattgagaaaattcatgaagcattgccggactataagtatgtaccgatgagggatgttcgagaagcaatgtatccagagaagatgaccacagaacagttggcagaggcaatggatgagattgcagaagcttttgatccgtatgagtatcgggataatgttgagatgggagaaaatacggtacaggaagtaatgttggatttacaaagcggtaatattcattattatgtttcttacttgaaggatattgtagacgaagaatgcgaccagtctgtgcgtgcaggtgtattgatggaaagactgaaagcttatgaaccggaacttcccaaaggtatggaaccaatggtgtatgtaaacttctgtgaagagagtaatttcatgaatccaagatgtcagaagttatccgagttggatgcaaaaacagcagaaatggataaagaatggtatacaaaacgtgatccgaagacagaggaacctacaaaaatcgcaaagatatatgtgacggtatattatgcggaaaaaggcgaacagatgctgcatcatttcaagaaatcaatggatattggaaatggacatggcggtattgtgagtcagttaaagtatgataatgaaatgaagcttacagatgagtattggatcaattaccagaaaggcaaaggaagtgaagagttccaaaagtatatgtaagatctgatggatatgcagaatcatgtactgccgtatttgcagagcttttgcagtctggaagaaaaaggtgtgaaggagagacgagaacagcaggtggcagagaaaaatgagagcagagaagctgtgccgagagctggtgttgaaataaatacagcagttaaggacgcagggaaagctgaaagaaaggcagtagcacagaaaaagacaatgccagaaaaagaaaagaaaccgtcaatccatgaatgcttggaaatcaataagagaatcatccaggaaaagcagggaaaagataagccggagagaggagctgatttgggtgtaaggacagtgtagtataagcacaatgagtcggaggtcacggatgataacgtggcttccggcttttttgttttgaatatttctggcagaaagaggaggtgttctgttcatagatgaagcgtatgctatgaagagtgacacagctattacagtgctgcttcaggaaatggaaaatcaaagagaaaatgtgattgtcattcttgcaggatacaatgaaagaatgaaagtatttatgaagagaaatgaaggattgaaaagcagaataccatattgaattgattttccagattacacaacagaggaacttacagatatttttaagctgatgatccatgaaaaaggattctgtgtgacagatgacgcaatcaaagaggcgcattatatctttgaaaaagttagaaatatcgatgattttgggaatagaagatatgtacgtaatttgatggaacgtgcggttagacagcaatccgtaagattactttcacaaagaagaaatctgggtgatattcaaaaggatgaactctttcagattacgaaagaggatatccagatgcttggagagggagaaaagaaggagagaaaaccggaaacggctagaaaagaattagatgacatgatcggtttagcttctgttaaaacagtgattcataaagcgattgccaaacataagataaacaagctttgtatggataaaggtcttcgaatggaaaaatcttctttacatatggtctttacaggaaatccggggacagctaaaaccacagtagccaggctatttgcagaaattatgaaagatgagaaagtattatcgacaggcgtgtttgtagaagtggggcgtgcagatcttgttggtgatcatgtaggcgctacagcaccattagttaagaaaaagtttaaagaagcacaaggaggagtcctttttattgatgaggcttattcactgtgtgacggctatgacaatggatttggcgatgaggcaatcaatacgatcgttcaggagatggaaaatcatagggataatgtgattgtaatctttgccggttatccggaaccaatgaaggcgtttcttgacagaaatccgggtatgcgttccagaattgcatttagcgtagaatttgatgattacactgttgaggaactttgtgagattacaaaattgatgctttcaagaaaacaaatgacaatcacagaggcaggaatgaaaaagttaaaaaagaatttcgagagcgtaaaagatagcagagactatggaaatggaagatttgcgagaaaaatgttggagaatcttatgacctggcagtacaatggcagcaagtcaaccattgatgagtttcggacattgagccgggaaatgcaatatgaagtgattgattttataaaagactttatgatttacgaagaactgacagttaatggaaaaaactatttattagttcacggaggattgggaaattactatccgggaaaagatattgaagaatattccttaaaagaattgatatgggacagggctgagtatgatatccaatattttgaagatacatacgtggtaacaggacatacaccgacacaaggaattatggggaatccaaaaccgggttatgtatacagggagaatcatcatattgcgattgattgtggctgtaatcgaagaaatggacgtttggctgcagtttgtctagatacaggacgggaatattatgttgaaaataaggtgggaaaacgaaatgattgatttacaatatgcgaagaaagcttttgaaaactatttgaatgattatgaccaaaaaaatgaaaagataaagttgaagattgtgcatactcatggagtgatggaatgcagtaaaaaaattacagaagatatgaaactgtccgcagaggattgtgagctcgctcagattattggattgttacatgatattggaagatttgaacaattgaaatgttacaacagttttgaaccgggaacgatggatcatgcagcattcggtgtgagaattttatttgaggagagactgattcggcgttttgtcgaagaaaataagtgggatgaaattataaaaacagcaataggacatcatagtgattactgcttaaaaggaattacgaatgagcgagaattgatgcatgctcaaatcatacgtgatgcagataaacttgacaattgcagagtgaagctcgaaacagcaattgatattctcatgggagttactgcagaacaggtaggaatgtcagaaattacgccagaagttatgcggcaattcaaaaatcataaatcagttctattagagacaagaaagacaaagatggattattggatatcttatcttgcatatttttatgatataaattttaaagcgacatatgaaagtataagagataaccattatgtggataaaattataggaaggattccgtatacaaatccagatactggaaaacagatggaacaaataagaaacgaaatgaatctatatattcaaaacgctataaatgagaatggaaattacagataaatataattgagattttgaaggcgatttacaattttcagcatagtgaacagaagatgaataatatatgtaaggtggtaggaaatggcttattacataacaggagattgccatgcacattttgataagttaatctggttggcaagattcaataaagaacttggaaaagaggatgtgatcattttattgggggatgtcggattaaactattttggggctgacaaagatcgggagaaaaaaatacttgcggattttccaaattatttcctgtgtattcatggaaatcatgaggaaagaccttatcatatacaaacttacagaacacaaatttgattagattattcgaaatggtatttcggacattatcatgacaatattcaatatacagatgctcaactactgtatgaagaaatcaaagagttaggagaagcagattctgttcagaaagtaggaagaccaaggtacagagtaggagaaatggtgtattttacctttggaaaagaggacgcaagggaaggatacgaaacggattaccatggtttgaatcagaacagccggatgaagtgataaaagaatatgtggaacagcagttggataaagccaagtggaatgtggatatcgtactctcgcatacagtaccgattgaagcggaacccgtgtgggcgtttattccagggcttgatcaatcagcagtggacaagacaacggaaaaatggctacagaagatttatgacaggttagatttcacagagtggtatgcaggacattaccatgtagaaagtgaggagtgtggaatacgaattatgtatgaagattatgatgaaatttgtgctgaaaaggaaaagttttgaatatcatagcaaataaactcatgctaaaggggaaagagtatgcgatcagctttttagatggcggtggatgatgacatccttgtaaagaatccattcggatttcagcttgccggagtattggtaaatgacgcagtcacaagagaggcaatttccaaaaaccagatgagaaagttcctaaagtttgtgcatgacgatgtggtgtactgtaaatattatgaagtggtgtacatactctttcatacgggaacgcgaatatcagaattttgtggactgacgctgaagaacattgatcttgagaacagaaccgtaaatatcgaccaccagttgcagagaacatcggatatgcgatatatcatagaaaccacaaagactgatgccggaacaagggcactgccaataacagaaggatgtagcagaaatgtttcaggcaattatcgaggacaggaatgctccaaaagtggaaaaatccattgatggctacagtgggttccttttctatgatgataatggaatgccccttgtggcaatgcactggcagcaccaatttaatcatatggtcggcagatacaacgatatctaccgggtacagatgccaaatattacaccgcatgtgtgccgccatacctactgctcgaacatggcaaaatcgggaataaatccgaagactcttcaatgtttgatgggacattcggacatagcagtaactttgaatgtctataaccatgttggacttgaagatgcggagaaggaacttcacaagatgcagagtatggaagatgctagaaaagagatgggactttcagataaggatgatagaccattaaaacagaatatgttcaaagtagtgtagtgagttataaaattagcacttaggcagaaattaatatgatacctctgaagtagacaaggtaaataaccaaaatctactttggaggtatttttatgggaagaaaacccaagtgtacggttgaagaaaaaatttctgctgtcgaggattatctgaatggaatacgttctgtctctgaaattatggtagatttatctataaaaagtacacgaactataagagactggatactggcatatcaaagtgggggaataaaagccctctgctctgttacagctaaccattcctattccagtgaatttaaaattgaaatggttcggaagtatatcaacggggaaggatcggttaccgatttatgcgccagatatggaattcctgcacatgcaacactacaaaaatggatttcgttgtataatgccaatagagaacttagggattatgatcccaagagggaggtctatatggcagaagcacgaagaaagacaacgttagctgaacgtaaggaaatcgttgaatactgtattacccataaccgtgattataaaggaacagcttctctatatgatgtttcttatagccaggtgtactcatgggtcagaaaatatgatgctgttggggaagatggactgtccgataaacgcgggcaccacaaaacggatgatgaagtcgatgaactggaacggctgcgccgggagaacctgcgactaaagcgccagcttgaagaaaaagatatggtggtggaactgttaaaaaaagtgaaggaattcgaaggaatgtgaggcttggaaaactacggtttgaatcaaaatatcaggcaataaaatatttttacgaaaaaaagcaatggagtgtcaactggatgtgcaaacaattgggcatatcacacgctgcttactataaatggctacaccggacaattccagagcaggaatccgagaacacaaaactggcagaactgataaaggagtatgacgagcggttcggacatatcttgggatacaggcggatgacaagctggatcaaccatttcaatcacaccagctacagcaagaacagggttcacagaatcatgaggaagctgggaattcattctattatccgtaaaaagaagaagaaataccagtcgtccagaccggagacaacagcggaaaataagctgaagagggaattcaatgcaacgaaacctaatgagaaatgggctacggatgttacggaattcaaggttcctgagactggcaggaaactatatctcagtgtcatcattgatctatatgatcgctttccagttgcgtatgtcataagcggaagaaatgacaataagctcgtgtttgacacatacgataaggctctcaaagataatccggatgccaggccgatttttcattctgacagaggttttcagtacacgagcagaatatttcagaaaaggcttcgagaacaaggcatggaacagtctatgtcccgtgttggacactgcattgataatggtcctactgaaggattatgggggattatcaaatcagagatgtattgtatgtataagataaccgacgagatatctttacgttcggcaatcgacaaatatataaaattttatgccgaagaaagactgcaggaaagattccattgcaaaacgccactggaagtacgaagcgaagcattatcagcggaaaccccgatacaatatccgattgctgagaacaaaagaatagaagcatacaaagcaaaatggtgtgcataaacgtctcataacataaatatccgccacactgagtcaaatgtggcggatatctataaacttattttagattttttacttgtctacttgacagggggctgatcaaatgtctaggtgccttttggtgttagcgccacttaacgattgtgggtgtcaaaacacccgtttagtgatataatgaacttcgtatattcatttaaatggaggtgcttatcatggcagtcccaaaagttgacggacaatttatagcagaggctattaaatatattgatgagaatggagttccttggcacaatacaagtaccaagtatgagtttgtatgggaaaacggtaatacctatccaccaaagtatgtcatcgcagtagcaaatcatttgcagaatggtgcagagatagatgtatctggatataatgctgtcgaagcaaaaaactatcttattgcaaaaggatatgagattcagattaagcagacaaaatacgaaattactataacatcagattctgttacttctactgatgattcattcactatggataatattagtgcaggagatgtgttcaagcctttggatgcatcatttgttgctgtcgatggaactgttatcaaaagaaattatgggaaaggtgagagacggaatacaaaccaaactttaccacgtattgcgtttcaaatttatgaaaaacagattgcagccttgccagtagaagaaaaagaacagtttccaatttgtcaatacgctccagataaggaaatgattcgtggaatttattacagcaaggacgaagcaaaagcacacaatataaatccgttcaatacaatgtcgtatgattatgatgatggtagacagtttgtaatttattcatggaatatctttacaactcttagatttgttcaggagtgtttgacacgtttcggtaatccgggagattccttcaaattggtttatcgtgagaaggacgagaaggaaaatgcagaggaagaggcagcagttgtagaggaagtaaaaccagcagaatttaatggctatctgaatccatattctactatgcttgtggaatctaagaacattatattccgaggtgctccaggaactggaaagacttatcttgcaaaagaaattgctactgacattattagcaatggatattttaatgattatacgatgcttacagatgagcaaaagcaacaggtagagtttgtccaatttcacccaagttatgactattcggatttcgtagaaggactccgtccaaagacgaatgaagatggttctatgggttttgaattgcaggatggcgtgtttaagaaattcgtggataaggctagaagaaactatgagaattctaaaaagtccacagaggtcattgcaaatgaattatctgttcaagaagcaatgaaagagttctttgatgatgtggacacaggaaataacacattcaagactaaaacgggtacagaatttacaatcacagatgtcgatgatgagcatatttatctttcaataccacaaaatgcatccatcaacagtatccgattgaatatttctgaaattagacagatgttagagtctggaagagaatttaacaaattaaaagatattacagaatttttcaatatcaattttacacagcagagatattcctacaatcttgttatttttaacgagattcagaaaaagaaaaaggctgcaaagattataagacaggaagagttgaagaaatatgtattcatcattgatgagataaatcgtggtgagatatctaagattttcggagagttgttctttgctgttgatccaggatacagaggtgtggcaggagaggtttccacccagtatgcaaaccttcatgctgatagcaatgaaaaattctatatcccagacaacgtttatattattggtacgatgaatgatattgacagatctgtagacagctttgatttcgctatgagacgaagattccgttttgtggagcttcgtgcagatgagcgccttgagatgcttgataacttgaacaacgaagagaaagaggctgaggcaattgccagaatgtcagctttgaatgtggaaattgcagcaacagaaggtctgaatgaaaactatcagattggtgcatcctatttcttgaagctgaagaatattgactttgaccagttatggtcagattatctacatccgttgttacaggaatatataaatggtatgtatgatgaagaaggtattatggagcgatttaagaaagcatataaccaagggaagtcggatggagttgatgtagatgagtcgaattaaaataaaagataattcgagaatacctaaggcgtcattgtctggcatatcacttctgacaagcaaaattgcagataaaactttggagcagttggagaatgaagggatatttgtattcccggaaattcttagagatgcagatgatatcacaaaagaccagatgattttacagagtgtaaacaattattatttgtcaagcaatgtcatgggcttcatgggacttggagatgagaagctcatagttgaatcaagatttagtggtaacgggcaggacttcctgtttcaatatttgcttgagagagtatttgatgtcccgaatattgtggatttggaaacagatgcgaacaatgatgattgtgttttcaatctgcttgtttttatcttcccacattacttaaagagtgtcatgcgtaagggtgtctttaagacttatgtgagaaaaacatacaatgacagcaatgttaagggaacgatagatatagcgagacacattgttaagaatacaccatttgttggtaatgtagcatattcgcagagggagtattcctttgataatgatttgatggaattaatccgtcatacggtggagtttatcaaacataagtcatacggacataaactgcttgcacaggctaaggatgaggtcaaggatgttgtagcggccactcctaactacgagatgtgtaaccgacagaagattatcgatgcaaataagaccaataccattagacacgcatattaccgagaatattgtgaactgcagagcttgtgtctacttatcttacagcatcagaaacatcagattggaatgggaagcaagaaggtatatggattgctctttgatggcgcatggctctgggaagagtatatgaattcaattgtggacgagattttctatcatccgatgaacaaagctacaaaaggttttcagcgtttgtttgaccataatcgcggacttatctacccggacttcatcagcagagactcagaggcacgagtgattgcagatgcgaagtacaaaccgattgataatattggaaacaaggactatctgcaggtattggcatatatgttccgatttgatgccaagaagggattttatttttatcctgaaatgggagaggaagaagatgctgttatgtggctcaatcgtggttcgacttatgagaagaatgtagaggcacgagaggatatttgtctcatcaagcacggatttcagattccgaccgggatagatgtatatagtgttttcacagagcagatgcgatgtaatgaaatcaaattccttgatggaattttaacgtccgtgaaataggaaaaatataccttttaacgatgcaccccctcggtttagaaatactccaaagggggtgcaaaatccagagtagtaatcccgaaaattttgactacgattttactacgaatgaggggtgtgaattgcactgttttgccgtattttgcaaaatcggcacttaaaatgtaacttttataaatagaagaaacaagtcggcaaaatgccccaaaacacggcatttctcggctttttatgataggagaattttatgataagagttttattcatctgccacggcagtattttccgcaaacgctgaaaaccttgaatttatcgtatgttttggactctaagggaacattttactaagaatttactaaaacaaaaaattagtaagaaatccctagcacgaatttagaaatgaatatgaaacttaggactttattagttgtgaaaaacaattagtaaagtcctttttatttatctaaaggaggatcagaacatgaacaacacagcgttaggagcagaaaacaaaaaggaacagacaatcaattttatcagcgaagcacatgaaaaattctactatgaaaaattaaaagaggtacgctatcaggatgtgtaccacaaggcactttgctattgccttggtatcagcgatgatacgagaagaaatgttgatagcatctatgattttaagacgggatgtgtaaaaactgagtgtctgcatgaaggctggcagaccagtggcagtatgaaggtggtgcgaatggcatttaacctgtattgcaacggcacaccgagtgtagatgattacacaaaaacagaggaacaggtaaacgagtgcaggcagtatacagtggaggacttgttctgctgagcctatgcacctttcttttggcaggcgatacagatccgctatccggagtatgcgacttataaccgggaactgtatgccttatttggaggagcagattgatgttaaaagttcgattgatgggaacaaagaatgatattaaatggtttgggaagattttgcagagaaatctcaagattgaagtaacagagttttcagatttatacccgaataaagggacaaagaagttttacagagcgtatgtagaagtgaaaaagactaatgtagcagaaagttagcaaagaataaaggagaatgtatcatgtgtaaaataatagcaatcgcaaatcagaaaggtggagtcggaaagaccaccacaacaagcaatttaggaattggattagcaaagcagggcaagagggttctgctgatagatgcggacgcacagggcagtttgactgcaagtttgggatttacagagccggacaagctggaggaaactcttgcgactgtgatggcgaatatcatcaatgatgtggaaatggaagatgattacgggattttaaggcatgaggaaggaattgaccttatgcccggcaatatcgaattattcggtctggaggtatccttggtaaatgtcatgagcagggagcttgtgatgcgttcctacatagagcaggtgaaagacagatatgattatatcctgattgactgtatgccttcacttggcatgataaccataaatgcatttgcctgtgcggatagtatcttaattccggtacaggcggcatatctgccagtgaaaggtctagaacagcttattaagacgattggtaaggtgaagcgtcagataaatccgaagctgtccattgagggtattttgctaaccatggttgactgcaggacaaattatgcaaaggacattagtgcattactgattgagaattatggcagcaaagtaaggatatttgagaatagcattccgatttccgtaagagctgccgagatttcggcagagggcgtcagcatctatcagcatgacccaaagggaaaagtagcaagtgcctatcaatctttgacggaggaggtgcttggcaatgaataaggcaggaagtgcggcaaaggtaaagctaaacagttttgatgatttattcggtgcttctgatatgacagcgggcaccgatcaggtgcaggagatacctctttcagaactttatgagttcagaggacacccttttaaggtactggacgatgagaaaatgcaggagacagtggagagtatcaaaaattatggtgtgcttatgcccggtattgcaagaccgagggcagagggcggttatgagataatcgctggacaccgcagaaaacatggctgtgagcttgcaggtctttccaccatgcctatgtttatcagagattacaatgatgatgaagctacggtgattatggtagatactaatatccagagggaagatattctcccaagtgaaaaggctagagcctattctatgaagtatgaagccatgaagcatcaaggcaaaaagggaaaaggaagcagtcttgatgaagtgggagaagcagctggagagagtggcaagacggtccagcgttatatatggcttgcacgtctgtcagatgaattgctggatatggttgataagaaaaaaatcggtctggtacagggtgttgacatatcttttctgacagagcaggcacaggaatgggtgcaggttattcttgaagaaacgggtgtagctatatcgactacccaatcatcaaagttaaaggaatatgggaaaaacggagagctgactctgccaatggtaagactgatattgacggaggaaaagccaagggaaagaaaagttacaatcaaggctgataaaatcagcagatattttacggaggattattccagtgaggatatagaaaatattatctatcagctattggaagaatggaacaccggaaaggcgtcgaataagcagtaaaggaggcacggtaaggtgggcgatacaataaactttgattattactacggaattgaagcagagcagttctctttttatcgtgttccccgacttttgattaaagacgagagatttaaggggcttagcagtgatgctaagctcctctatgggctgatgcttgacagaatgtctttatccatgaaaaacggctggctggatgatgaaaacagggcatacattatttatacggtggatgccattatggaagatttgggatgtgcaaaggcaacctgcgttaagattatgaaagagcttgataccgaaaatggaatcggtctgattgaaaagaaacgccgtggacttggaaagccggacataatttatgtgaagaatttttctacaattactgatgcaaagacagaggaaaagaccgataatgctgataaaaccacagaagttcaaaaactgaacctcaagaagtctaatatgcatacttccagaagttcagaaattgaacttcaagaggttcaggatttagaccaccagaagttcacaatgcagacttcaagaggttcagaaagtgaacttgcagaagttcataaagcagaccctatttatactaactataataaaactaaccagagttatattgatatgagttataccaatcctatcaatcaatctggcaatgagagtaagtcggaaaaaaggattgatttgatggatgatgtcaatgcatacatagaactgattaaggataacatcgaatatgagcatcacatgaagtacgatgactggcagaacaaggctttgtatgaggagctttttgaggttatctgtgaggttgtatgcgtaaagcgtacaacaatccggattgcaggagaggattatccttatgagcttgtaaaatctaaattcctgaagctgaatagtggacatctggagtatgtgattggctgtatgcatgatacaaatacgaaaataaccaatatcaaggcatatatggttactgctctttataatgcaccctcaacaatgaaccattattatcagcaggaagtgcaacatgatatgtatggaggtggctggcatgaaaaaggcattgtttaaaataattattccggtatgcgttcttgttctttggatgattacctgttatccggtttgtaataaagcagatgggtttgattatttcctttattggattttggtaggatgtccctatggtatcagaaaaatgtgtatgtttcttgtgccgaagaattttggaattgcaggaagtatgggaatactggcactgaattgtatcgttggaggtctgattggtggtattattgttcttgtgaggattatcgttatatttacggagataataaaagtattagcaggacacttatggacacaatgtccaaaggtgtaaaagaaaaaagggcaacaaaaaaggcattgtcaatcaatcataaacaatacctctacttgtcatctggaacatattccataatatcttcaatccggcagttaagtatctgacatagcctgttcagaataatggtctttactaccatattttgccggagccgctgaagctgtgctttgtcaatgccataatctttaatgagctggtactgactgatgttcttagccttaagcgtttgccaaaggggatcatatttaatcatacaggcaactcctttcctaacttgtattttaatggcagggaacttataataatatggtgcgtgtatgcaccataaagtatgtaaatggtaaagacaataatggtttatttctggagattgaggatatagatgcaggtagtgtggttttgaaacaggaggatggttaattgtgaaagaaatatacattacagacagtgaaagggaaaaatgcagaaaggttgcagatgcttttgcagagctgtatgagattgagaatatacttgtcgtggatgcgggaagatacggatttgttaagttacagtattatagaccgccacagggttttgaagatgcaataacctttacggatagccggagcatgtttgaaaacttgtgggaggaatggtttgacacgcagctttttcttctggcaaaaggaataccgatggcaggaatgggatatcatgagatattccgttgtctgccaaaggagaaacaagaggaacttatgaatagaaaagccgggtttgcgaaaacggcagaaatagaataatcaggtaacagcgttagggcagttatgagtgaaatacttgtagctgctttttttgtgcttttggacacgatgtccagaagcgggaaggagagatatatagatggaatcaatgagagatattaacagggtaatggagcgtgagatagcgaaggggagctgccctttaaagctggatcatattgaattcggagattattcgtatcaggagataacatcaaaggaaaaattgctggaggtgttatcgtatttgttgcggataggtgatttcaagcagtatgccggaaagacgattctaaataatgtttatatggacctgcgagggaaaaagcctgtatttaagagaaccaagacagctatggaaagaaataatatatttgcaacaatcagaaggtatgcaaagaagctaaagccgcagtataatggagatgtatatctggaaacggtcagatgttattttgatataccgaaagaaaatctggaaaagtgccgatatacatataaagggaacgaaacatacgcctttccaatgtcagacaagtacattatggcattgtatacgcattgtctggtgacgaggaaagcagttgctacacaaggagtacagatcaagggttttacagaaaaagagtatggaatggtaagactggagaatgtgggggatgttttgtttcaggcgttgctatgggatagaacgaaaagagaagggcaaattctttgcacagatttttgtagtatctttattttgtaatatttttttagtgaaatggagggaataaaatgcaatttagtgatgcatatgaaaaaatattatcttatgactttttagatgatgatacaaaaaaacacatatatttagaagatggcgataaacatatgtgtcgtttttgtggagagggagaggatgagactgtatttgataaatcggctcatgcaatttctgaaatggtagggaatagatggttgttttcatatagagagtgtaaaaagtgtaatattgcttttggaaatacttgtgaggatagctttggtaaatttgttctaccattgaaaattgtttcgcaagtttatggaaagaaaagaagtattgggtattcaaatgaacattctcaaataaagataaataaagaagatgcaattttaccagaatttagtgaagatattaaggcattgataaaatcgaatgaagaaaatagtgtgttgattccggaaaaggatggatttattcttaaattagtaagaaaacgatatgtaccacaacttgtatatttttcattgttaaaaatggctttgactattttaccatttgaggaatatgaaaaatatgtacattgttatgcaatgctatatgcagtaagtagggaagaggaaaaaactgatggaataaatgtgtatggatttgaggaattcatacctggaccagaaaggtttaagtgtactaatgctgaattgtatagagtgaaagatatgtctggtaatagaccatatatgtatttttgcttgaactttgggaactattcattgcagattcctcttccaacagatcagcaacaaagaggaaaaagtatctctgtagtaggttgtaaacaccatgacaagtcggaaataagaatattaaggtttaatgaatttgaagaaatatttcaatgccattttagtgctgttatgaaggaagtggtaggagaagaaaaagagagattggccaaatgtttaaacttggaatttcaaaatagagctgaataaggaaggaacgaatatgaagtgtgcatattgtggaaatgaagcaaaaggaacgaaggaacatattatttcatgtgcaattttggatttatttccggagtgctatatcacatttgataatgccagacacacatcgcatgaatctgatccaatggttaaagacgtttgtgctgtttgcaacaatcaaagaatttcttacattgatagctatgccaaagattttattgctcaatattttactaaaaaatatcgtgaagatgatttggtcgaggtggaatatgactatgtgatgatacagaagatgttattgaaatatgcgtttaatgacatgaggtcacataaatgggattgttccttttttgaacaggagattattcattaccttatgaacgaagaagataatgtcccgaaagataatgtgactgttatgtgtggagtggctgttaatgtctcgcctgttccagatgctatgtttggaaatttaaagctacgttggtgtaaagaccctattttgtatgccaatagtacaataagaaatattgattataatactgggcaagtttacctgaatgataatattgagatagaaaaatttgaggacttagcagtttcttacttgtttaaatttaatagtgtgcagtttttgcttatgtgttggaataaagagtcagataaaattaagcagaataatattgtattggaatgccaatatccatatcatttgatgaaagcagaagaaacaaaggcagttttgccaatatgtacagatgaatctaattatcatcattttgagcatattcatgttcgttgggatggattatttgaagttgggcttatgagaaaatatgcaagtggaggaaagtttgtacataaggaagaatatgaaaaagaatgggttaaggaagaacaaaaaattataaaagaacacccaagagggaaaaaataattacagcgtcaaggcagttataagtcgagagatttgtagctgcccttttttattgctgttggacacgatatccagaagcggaaaggagaattatgaggtatttattacatcggctgtatgttccgccttagcggagcatacgcacaggaagatgcagctcggaggtacttatgcaagaggaagtaacgcagaaaacaatcgctcttgtaattaagatcgctaaattggatgccaacgtcttgaaggttgcaatgcggatgtatctgaaccaccgcaggcagaaaacacagaaaacgcatggtaaaacttctgtgaaaaagctggttggtgaaggcgtgggagtttcgtctatcgaagtgacggacggcaatatcaaatcctttgagcgggtagctcgtaaatataatgttgatttcgccgtcaagaaagacaagacaacggacccgccgaaatatgtggtatttttcaagggcagggatgccgatgcagtagcacaggcattcaaggaatttgtttatggtaatgagaaacgaaagggcaggacttccgtaagggagaaactgaaacgctttagggatgcagtatcacagaataagaacagagaacggagccgggaaaagaataaggacagggggcagagcccttgagtaacatcattgaaggcataaccaaagacctgacggaaatcccgaaaaatctgaaagaaaaagcaggaggtatggataccaagaagctagtgcttttgaatctgccctatatctttgctgggtatttctgtgacaaggttgcatggttgtggagagtatcggaggggacaaatgcttccgataagatgatggcagtcatgaaccgctttgataagctgtttgccaatcccttgcccagcttccacccaagggatttactgattggtgtggcatgcggcatagcactccgacttgtggtgtattacaaagccaagaatgccaagaagttccgacagggtgtagaatacggttccgcaaggtggggaaatgccaaggacatagagccatatatggattctgtgtttgaaaataatgtccttctgacacagacggaacggctgatgatgtccggcagaccgaaagagccgaagtatgcaagaaataaaaatattcttgttatcggtggttccggttccggtaagacttgcttttttgtgaagccgaacctgatgcagatgcactcgtcttatgttgtcactgatctgaagggttagattttaagaatacagagaaaataggtcattaaaaaatgaagtgttttctgtgtgttcttattttttagcattatgaaaggagctgagaaaatggctaaagataatagaataacagcactttacgagcgtctgtcccgtgatgatgagatgcagggcgaatccaactccataacaaaccagaagaagtatctggaagattatgcagtgcaacatggctttggtaatattcagcatttcagtgatgatggatattcaggaacgaacttcaacagaccggcattcaattctttgctgacagagattgaagccggcagagtgggaacagtgatcgtcaaagatatgtcccgatttggcagaaactatctgcaagtaggtttctatacggaaatgatgttccctaagaaaaatgtccgttttattgcagtaaataacggagttgacagtgccaatccggcagataatgattttacaccatttctgaatatcatgaatgagtggtatgcaaaagataccagtaagaaaatcaaggcagtgttcaaggcaaaaatgcgagacggaaaacgtgtcagcggtgcagtgccttatggatattacagaaagcctgaggataagcagacattgtatgttgatgaagcttctgcttcggttgtcagacgcatttttcagcttgcttgtgatggaatgggtgcaaccgcaatagcagataccttgtcagaggataaaatccttattccttcggcttatgcgagacagaatcatcctgaggattgccagtgtacgaattaccatgacccttatacatggaatgctacaacagtgggctatattttgaacagacgtgagtatttggggcataccgttcttgggaagacaacgagggataattttaagacaaaacggaaaagaattgcaaatgaggacgaactgcttgtcttttacaatacacatgaagctatcattgatcaggaaacatatgataaagcgcagagaatgagaaaaagggtatctccaaggcgaaacagtgaaaagcctgcgcacaggctgtcaggactgctttattgtgcggattgtggaagcagactggcatatatcaattcaaagccaaaagatgggaaaatatatgacagcaatcaggcattccggtgtagccggtaccacaataaatatcattcatgtactggtcactatatcaaggcaagcacaatagaaatgctgatttatcaggcaactaagagagtgtcacagtatgtccttaaagatgaaaaagagtttgtagaacagttgaaagcacagtatgaattgcagtgtgaaaaggataatacagatgataaaaaggagttgttagaagcaaaacgtcgtatgatggatttggatgatctgataaaaggtctgtatgagaatttcacactggggcgattgccggagagacagtttaaccgccttatgacagaatatgacaccgaacaaagcagcctagagcagagaatttcagaacttgaaactgctacagaacgtatatccactaaggcagtgcagattgataaatttgtgcgactggttaagaaataccgagattttgaggaactgacaacacctatgcttaatgatttcattgaaaaggttgtaattcatgaagcagagggtggcagaacaaaagaccgtactcagcaagtggatatttatttcaatttcattggaaattttgttcttccactcagtgaggatgaagtggaagccttgtagtcagaggaagcacgcagagcggaagagattgctgaaagaaagagaaaatcttctaagaaatctacgcagaaaagaattcagaagcgtgcagagatcaaggcaaaagcagaagctggagatcctgaagctatggcagaatataaagcaatccttgaaaaaggcagacagaacaaccgtaagagatctgaaaaaatgcgagaattgagaatgtctgaccctgaatatcgggcgaagatggaagagaaagaacgcttggcattggaaagggaaaagaaacgtcaggagcgtgctacaaagaagaaaaagattgctttggcagaattaaaggagcaggcagaaaaaggcaatcaggaagccgtcagagagcttgaggagagtagagctattgcaagagaacgttcaaggaaatcagcagaaaagcgtaagcagagagcagaaaatgaccctgaatatgcaaaatatttggaagagagaaatgcagaatacaacagacggcataccgcaagaagaaaggagcagatggaagccttgagagccagggcggaagccggagatcaggaagcaaagagtcagcttgcagagcgtaaacagtatcaggttagagccacagtgaagagctacagaaaaatgcgtgaagatgcattgaatggagaccctattgcaaaagagagatatgaaaaaacactggctatgagacgtgaagcgtatcacgcaaagaaaagtgaacagacagcctaagagtaagcataatatcacaatataatagttgcagaattgatgagaataagcgagagcgatgcaattattgtaatggacaatgaagtatggtattgtatagatggtttaccaaatcgaaagttgtggaggtgaaatgaatatgatgatgttcttaaaattaagaaatatctgagttcatagaactatgttaaatagttttatgtataggcagaacccgaaaaactatttaataaaggagattgtgcaatgatatttcaagataatgtaatcaaagagtacttaaaaaatgtttattttataacgggaataccttgtggaggaaagacaaccgtttcacgtgcgttggcggaaaagtatggatttgaactatttgatgttgatgagagattcgacgagcacaaaaaaatgtcgaacccattatttcagcctgcgatgaatacgtattttaacagtgcagatgaattttttggaagaacagttgaagaatataagaattggctgttgaataatactcgtgaacagttagagtttgttcttcttgatttgattcgtttatcagaaaataagaaagttttgtgcgattgtcatcttacagttgctcaggcactcgctttttctgaaccagcgagagttgtttttctcataaaagacccatctaatcttgttgatgaatatggtaatcgaccagatcatcagggattttttcagtacttaaattcagcgactgatatagaaaaagccaaacaaactgtgaatattaccttatatgaactcaatgtaaatcgcatagaggagattaaaagcagttctttcttttggatagagagaactgtggatagtacagttgagagtacattaacttgtgtcgaaaaacatttaggtttaatatagttgaagaaagacattcgattatagcacattttgtttaatgaattagtgccacaaattgagaagtattcttgatttgtggcatcttaataaggcagaataaaggaataaaaagaatcttaattctgttaaacgctattgacaacttcatatttagtgaatgataacaatttataatttagtattggataaagaataaaaaaggaagtaagttatgacgaataaagaaataatggatatagcaatgcagcaatctgcatatgacacaaatgcaaaggtttctgacttccttcaggatacaaatgtatttgttaaatctggagttggacctttggcaagaaaatattataaagaacctatcgcttgtaattttgtgtcttatggaagcaatgtagttgcatctgtgaaagatgaatttaaagaaatagttgaaacatatctgagtaagtttgaattttatcattgttttgagacgcctaacatgcactggcttgatgaacggatgaaagaaaaaggatatagagtatgttttatggcagagtattttttgccggatatggaacgattgaaaagattagagtgcaattatgtccttaaagtgttagaacaaaaagattttgcagatttgtatcttccaatgtgggggaatgcattgtgtgcagatagaaaagagttagatgttctgggagttggagcatatgatggtgagaagcttgtaggtctcgcagcgtgttcagcggattgtgataatatgtggcagataggtgtcgatgttttgcctgaatatcgaagaatgggaattgcttcatcactaacaagtaatcttgcaattgaaataattgaaagaggcaaagtaccattttactgctgtgcgtggtcaaatcttaaatcggtaaaaaatgcattgcgcagtggttttgtgcctggatgggtggaaatgacggtaaaagcagcaagcttagttgatgaaatgaataagtaataaattccgattttcagaacaataataaatctttattgctatttagtgaggtgtaaatatgtcaactggaattatgataattggtccatctggaagtggaaagacaacacttggaaaaatagttgcacagaaactgggatatctatattttgatgtggatgattatatttggaaacagaatacagatagtccatatacacaaatgtatacgagggaagaaaagattagcagactgaacactgatattgctccatatgaacattttgttatggctggttcgatgagttcctttcattatgcatttgatgatatgtttaaaatgatggtatttctttatgttgaaccagatattcgaatacaacgagttcataaaagagcaatagagcgatttggaagaagagtacttgaaggtggagatatgtatgaatcccatatgaaatttttgaaagataatcgaagttatgaagaagatggatcaccaaatatgagagaacagaaagaatggatgacaaatatgtcgtgtgtaaaaattgaattggacggtgctacggaccttgaaagtaacgcagatattattgtaaacaattggagtgggatagtggaataaattttagtttattctctcaatggggatagctttgaaaattgaaattttatctatgtaaagaacccgcaaatttcaggttgtcggattgtaaaggcagagccttacgcaaggtgcaggagaaagactccgctcgggttaagggcgaagcgccttagccggtcaagggtgcaaccattgcccagttagtggtgtttcgccactaagtactgggtattgcttgtagcaaagcttcacaagattaagcaacttcgttgcaattcccttcgggaaaagaactaaatattgttacgataaacagactgagtagagagatttacttggtctttttttatggaaagattagcatgaaagcaactaggcacaatggacggtcaggcaagcatggaacctatgacgcaaagcacaatgaccgcagatttgatgtagaaaatagtgagcatattgacgcagagagaacgaagatgaatgtgtactgggattgttatcaggggtacagcctgcagaatgataaggacgagcaggcgagattcacttttacggaaatagaaaaagcatattatgttgagaaatattcagaccatgtggacggtcagaatgagagaaaccggaaagcaagacactatgaccgagtaaaaacgattgatgctattcttgaaaataataaaacatgtccggaagaaactttattacagcttggaaacatggactgggctttgcatcttgatgaagcaacaccacatattcatgaacggcatgtatttgatgctgtgaatcagtatggagaattatgtccccaacaggataaggcattggaagaacttggctttgaacttccgaagccgaatgagaaaaagggaaagtacaataaccggaagatagtttttgatgaagagtgcagaaaactatttatcagcatctgtcagaatcatggactgacgattgatgttgagccggtatatggcggtgcaagctatctggagaagcaggattttatcatcatgaatcagaagaaacgcattgaggaaaaacaggctgttcttgatggtcttgtgatgaagatagaggacgtaaacgcagtcattgaagaagcagtagaccttgcttatgaaaaggcttgtgaggttgtcacaaagcgtgtgaaagaggaaacagtgaagcatgatgttgatgtcgtaaaggactatggagagcttttacagcaacagccgaaagataaactcagtgataaatcaaagtcggtggcttccaaggtcgtaaatgcgattgttgccaaactagaaaaagcatcacaggcacttttgggaaatatcatctctgccctgaatgagccgaaaaataaggttaaggcaaagggacagattaaggaacaggcaagggtttccattcaggcaaaactgaaagagaaacagaagcaggttatggaatatgagaaaaaacaagatgtgcatatcagaaaaaagaatatggaactttaggaagcatttgtaatccattagtggaaatacagatgcttttttattgtccggaaaggattgtatgggagtatttgatgaagtaaaggaaagagtgaccgcaagggaagccatggagagagcaggcattgttttcaatcgaaataacatgtgcagatgtccgtttcatcaggacaaaacggcgagcatgaaagtaaaaccgacagataaaaaatatttttgttttggttgtggggaaaagggagatgcgattgattttgtcgctaaatattataaccggtcaccaagagaagcagccatgcagatagctgacgagtttgggattatctatgacagttcggtgcgatcaccgcccaagccggtaagaagagagaaatatccaatgcagattcttgaagaaacgaaaacaaagacatatcgggtgctgtccgactatcttcatctgctgaaagaatgggagcggaatttcagaccggaaagcatggaaaagattgatgaaagatatgtggaagctgtgcagaatcgggaaaaggttgagtttcagcttgataccctgctgtggggtacggaagatgaaaaggaagcagtgatacacgatttaggaaagggggtggaagatattgagagaagagtcagggaatatcgcaggaatcagggaacagttaatcacaacagacaaaggagctgtgaagcagtgcattagaaatgtggttacagtctttgagaacgacccgaagttcaagggagccattcgttataacatgatgactgacagaaacgacattgttaaggggttagggtggtatcgtgagagtccggcacttacagattctgatatagaccatatcatgttgtattttgaagaacattacagccttacaacggaaaagaagataaaatcggctatcaatgtggttgctatggaaaataagtatcatccgattcgtgaaaaactaggttctctggtctgggatgggaaagaatgtatcaaagatgtgcttcatcacttccttggagccgatcagaacaattatgtctatgaagcaatgaaagtccttctgttagggtgatattgtcaatattggtttacacttttttcacaaggatgttcgaccttatgctgcctcttgtagtgaagtatagtattgttgccgcttaaccatcggaggtagtccaccattagcagagcagatcctccgattattccaataactgataaaatatctccaaataagagtttttaactgttctacagtcatcaaggtggcgtcgtagcgtccataaagtaattcttctttgaatcgtgcccacatactttcacatcttgcattgtcatggcatctgccaccggcactgttcatactttgaagaatgccatatttattgattgcgttacggtacaactcgctagtatactgtgtacctctgtcgctgtgaagaatggcacccggagcatcggatatgctttataggcattatctaaggtttgttcacaaagggcagctttcatattcgtatccatagccagacctaatactgctaaatcgtagcagtcaaagatagctgaaacatacagttttccatcggaagcctttatttcagtcatatctgtaatacacttttcgagagggctctcagctgaaaagtcccgcttaattaaatcatctgatttccgagctcctttatccgctttggtaataccgttcggcttacgcttcggtttatgagtaagaccaatttcttccatgacacgataaaccgttctctcaccaggaatgtctactccttccggctgtttgagctgtaacgcctgatacatacggatccttccatatgtatcattgcattcatcttcgcggcaaatagcaaccatcgcatctgccaacggctgatatttccaaggagtcgcttttgtttttagatatttattgaatgcctgtctggaaacatgaagtgctctacaataaaaagaaattttacccttgatcctgccgtcatccgttttgattgcaataaacattaatctctgttttttgctgacttccgacggctggctgcgaaaaaagcacttgcttcctcaagaaattcattttcttcctttaaacggcggatttccttatcctgctctttcacacgttttctgagctcgataagctcatcattaagtgataaagcatttttaggagtatgggatgcttctgaagcgctaaggcgtccttctttaaatgcttttacccagcagtaaatcgtgccatctggtatgcccagttctttagctgctttagctccacccatttcctgagcaagcttaactgcctgtgctttatattcgttgccataggtcctttgatttcgtgccataatgttttctcctgttctcgtattgattatgattatatcaaaatccttgagaatgtggtgtcaacttttatgatacaacatcattacaaggatacagccgccatcatactaaaaggggcatggcttgaaacactagggtttgagccggggacacctataaatgttgagtgtggcggaggaaggcttgtgattaccagagcagatgaagtaatttaggagtaaaaaagatgagctaagtagtgaactatggtataattaaaaaataaattatgaatgattatcatagatatttatggaggagcaagagatgccaaatatagataaagatgaaataaaagatagtgttgtgattcgtaatgtaacagcaacgtttgtaggtacaaaaggaaaagatggatttgcagaggtaattaaggattttgaaaacgcacaggaagttcgtgttttgacatatagtaaaattggaaatggtaatgacagtgataaaaaattaaaaataattagagaacttgcaccaggaaaaaaattaaggattattgttgcaattccaggattgttaaataaaaaaataaatggtcaaattcacacaaacttatattctgaagatgatattattacgcacctagataaaattaagaatcaaataactgcgatatattcatcagaagatttagagatgtatgtttgttttaaaaaccatgctaaacttgttggaacagaaaatgttctttacgtgggatcggcaaattataacgattatagccataaaaattatgaggccggaatgattatacgggataaaaatagtattaaagaaatatatgaaaaatattttgacaaagttgttgctgtacaatattgtgctgacaaatatgacaccataagattaaatcttttatcattggttgatgaaatagaggaattagaaatatttatacattgctttatatcttgctttgatgaaagagttgaaaatttcaacagcataaagaaacaatacgaggtaatcagtagcagaatggaagatattacaagatatattaatgataataagaaaaacatacccatagcattatcagaagacatatgcacaattgaaaatgatatagataatatttctgagtttatttcgggtgcatttgattcagattataataaaaatatggagtattttgcagattattatgaaaatgagcatatggataacaaaggagttttttcaagtgatgcgtggattgatgaagaaacaccttatgtcatgctgagcgaggagacggaacaggaatattatatttcagaatattggactcaagaaataacggaaaagtcagtggtaaaagaaactttagatttactaaatgctatagtaaaaacagctaaggtgtggttatataagaaaccttatgatatgtttaaagcacagttggttcagattggaactgatgaaaatgtactaaaataataagagaatagtatttgtatcttaaaaaaggtgtataaaaatggattaaaaaatgcaggtgctgatgagaaaaatacatcagcatctgtaaatatatttgttgttgctgattagtttttataattatccatgaggaacactttaaaatgaaacattgatttctcattgtgaaattgaggagtactaggtttaattctaaggtctctagcaatctgacgttttaaatgacccgtcataatcattttttttggttcccaagtttttctatctaattcaccaatcatagcgtaggaggatatattaaacgggagcatttaagaaagaacggatgatgaaggcatatgcacagttggaatatcattacaaggatacagccaccatcatattaaaagaggcatggcttgaaacactagggtttgagccggggacacccataaatgtcgagtgtgacggaggaaggtgttacaagggaagcagtcacaaaagaccagatgcgaaggttcttgaaatttatacatgatgatgtggtttattgtaaatattatgaagtgatttatattctttttcacactggtatgagaatttcggaattttgtggacttacgatgagggatattgatttagagaaaagaaccatcaatattgatcatcagctgcaaagaacttccaaaagagagtatgtaattgagccaacaaaaacaaatgccggaacaatggttattccaatgacaaatgaagtgacagagatgtttcgagcaattattgaggatagaccagattataaggttgaaaaagtggtagacggttacacgggattcctttttctggacaaggatggaatgccacttgtagccatgcattgggaacacagattcaatcatatggtcagcaggtataatgaaatttataagattcagatgccaaatattactcctcatgtatgcaggcatacatattgttccaatatggcgaaagctggaatgaatccgaaagcactccaatatttaatgggacattctgatataggggttacgttaaatgtatatacgcatctgggattaattgatgcaaaagaagagatgaataggattgcaaaactggcatagtatgataaaataatagaaaaaagaattaataataatctgattataaggttcttagaaagcctgttttccaggctgattattactaagaagttactaaatttggataagaaaatatacgaatttatgctgtgatatacaggaaaatgacaggattgaagattatcggaaaatgcctgtaaacagcgtaaatacagcatttcaaggagttttaagcaatgataagagtgttatttgtctgccacggcagtatttgaagaaaatgcggaaaacgctgaatttacggtatatttaggactcaaagagagagttttactaagaatttactaagaaagaaattagtaagaaatctctagcacgaatttagaaaaatgaaacttaggactttattagttgctaaatgcaattagtagagtcctttttattttcaaaaagaaagaggaggttctaaaaatgaacagtacagcgttaggagcaaaggaaacaaagaaggaaaacattatttttatcagcgatgcacatgagaaattctactatgagaagttagaagaagtaaggtatcaggatgtgtaccacaaggcactctgctattgccttggcatcagcgatgataccagaagaaacattaaaagtatttatgattttaaaacaggctgtgtaaaaacagaatgtttgcatgaaggctggcagaccagcggaagtgtgaaggtagtcagaatggcatttaatctttattgcaacgggactccgagcgtggatgactacaaggacaccgaggaacagataaacgagtgcaggcagtattcagtggaggaattattctgctgtgcctatgcaccatatttttggcaggcgatacagattcgttatccggagtatgcaacgtataacaagaaattgtacgccctgtttggaggagcagactaatgttgaaagtaagattgatgggtacgaagaacgatattacatggtttggaaagattttgaagcgtaacccgaaaatagaagttaccgagttctcagatttatacccgaataagggtacaaagaagttttacagggcttatgtggaagtaagcaaaagaaacgtagcagaaaaatagcaggaagaaaaggagaatttcattatgtgtaaaataatcgcaatcgcaaatcagaagggtggagttggaaagactaccacaacaagcaatttaggaatcggattggcaaagcagggaaagagagtgctgttaattgatgcggatgcacaaggaagtcttacagcaagtttaggttttaaggagcctgacaagctggagattacgctggcaaatgtgcttgcaaacatcatcaatgatgaggaaatggatacggattacggtatcctcaagcatgaggaaggcattgacctgatgccgggtaacattgaattgtctggtctggaggtatcactggtgaatgtaatgagccgtgaggttgtgttgcgttcctatgtggaaatggtaaaagatagatacgattacatattgattgactgtatgccttcccttggtatgattaccataaatgcctttgcatgtgctgacagtattctgatacctgtgcaggcggcatatctgcccgtgaaaggtctggaacagcttattaaaaccattggaaaagtaaaacgccagattaacccgaaattggaaattgaaggtattctgctgacgatggttgacagccggacgaattatgcaagggacatcagtgccatgcttgtagagaattatggaagtaaagtgcggatatttgaaaacagtattccgatttctgtaagagcagcggaaatttcagcagagggtgttagtatctttcagcacgatccgaaaggaaaggttgcaggtgcctaccagtcattgacagaggaggtgcttcgtaatgaataaaagaggaagtgcagacaaaatcaagttaagcagttttgacgatttgtttggcacgcaggaagcgggtacaggtacggaacaggtgcaggagataccactttgtgagctgcatgagttcagaggacatccgtttaaggtgctggatgatgagaaaatgcaggaaacagtggagagcattaagaactatggtgtgctgatgcccggtattgcaagaccgagagcagaaggcggctatgaaattatagccgggcaccgtaggcgacatggctgtgaactggctggactgtctacaatgccgatgtttgtcagagattatacggatgatgaagccacaatcatcatggtagacactaatattcagagagaagatattctcccaagtgagaaggcaagagcttattccatgaagtatgaagccatgaaacatcaggggaaaaagggtgccggaaacagtcttgatgaagtgggagaagctgccggggaaagtggcaagacggttcagcggtatatctggctttcccggttatctgatgaactgttggaaatggttgataagaagaaaatcggtctggtgcagggcgtggatatatcgtttcttacagagcaggcacaggaatgggtgcagattatcatggaagaaactggaacaaatatttccactgtccaatcagcaaaattgaaagagtatgggaaaaagggagagctgaccatgccgatggtaaggctcattttgacagaggaaaagccaaaggaaagaaagattacattaaaagcagagaaaatcagcaggtattttccggaggagtattcggaaagcgaaatagaaaatgtcattatagagcttttggaggaatggcagaagaaacagtaaaggaggcggtaaaaatgggcggtacaatcaagttcgattattattacggaatcgaagcagatcagttctctttttatcgtgttccacggatgctgattaaagatgagcgtttcaaggggcttagcagtgatgccaagctcctgtatggtctgatgcttgacagaatgtccttatccatgaaaaatgggtggcttgatgatgaaaacagggcgtatattatatatacggtagatgcaattatggaggatttgggttgcggaaaggacaaggcgataaaagtccttgcagaattagatacaaataaaggtattggtctggtggagagaatccgcagagggcttggaaaaccggatattatttatgtgaaaaattttgttgtttcgcaggaaacagaggaaaagcctgataaaatgcaagtggatagggatacacttgcagaggtcggagatgccgatttgcagaagtcggaaaaaccgaattcaagaagtctgaggagccgacttcaagaggtcggaaaaaccgacttcaggaactcggaaaatcagacttcaaggagtgggaaaaatggacttcaagaggtcggaaattcagcccctatttatactaactataatcaaactgatcagaattatactgatatgaattatatcaatcttatcaatcaatcggagagtgagcagaaaaagcctgattcgatggatgagatggaggatgtaaacgcatacatagagctgattaaggaaaatattgagtacgagcatcacatgaaatatgctgcttggcaggacaaggcattgtatgaggaactgtatgaggtaatctgtgagattgtatgtgtaaagcgtaccacagtaaaagttgcgggagaagattatccgtatgagcttgtgaaatccaagtttttgaagctggacagcggacatttggaatatgtgatgggctgtatgaaaaacaccactacgaagattgcaaatattaagtcgtacatggtgacggcattgtataatgctccctctacgataaatcattattatcagcaggaggtacagcacgatatgtatggaggaggatggcatgaaaaaggtattgtttgagatagtggttccggcggttgttctggcactctggatgattacctgttatccggtatgctgcaaagcagaagggtttgattatttcctttactggatactggtgggatgcccttacggtatccggaaaatgtgtctgtatctgataccaaagaattttggaattgccggaagcatgggtgtatttgcatttaactgtataattggtggtttgataggtggcattattgtgataatgagaattgcaaagatatttacggagataataaaagtgataggaggacacttctggacacaatgtccaaaggaataaaagagcaacaaaaaaggcattgtcggctaatcatccacaacaatacctttatttgtcatccggaacatattccatgatatcttcaatccggcagtcaagtatctgacacagcctgttcagaataatggtttttactaccatgttctgccggagccgctgaagctgtgctttgtcaatgccataatctttgataagctggtactgactaatgttcttggctttcagcgtttgccagagagggtcatatttaatcatacaggcaactcctttcctctcttgtattttaaatggagaaaacctataataatatggtgcgtgtatgcaccataaatatgcagattaagatagaaaaatagatgttaaaataaatggtcgaacagtaacaggagggatttatatcttgaaaaaaagctatattacagaagtcgaaaaagaaaagtgcagacaggttgctgatgcatttgcagagctgtatgagcttgaaaatatacttgtcatggatgccggaagatatggttttgtaaaattgcagtattatacagagaatcagggttttgataatgtatatacttttacggactgccggagtctgtttgaagatctctgggtggaatggctggatacaaaactttatctgatggcaaagggtacaccacttttggaaaaaggatacaaaggtatatttgaaagccttccgaaagaaaagaaaaaagagcttatggataaaaaagccgattttgcaaaaaaggcaggaatagaattataggaataacagcgtcagggcagttatgggtcgagagatttgtagctgctcttttttattgcttttggacattgtgtccagaagcgggaaggagaaaaacggatatggaatcaatgagagatgttaatcgtgtaatggaacgggagatagcaaaggggagcagccctttgaagttagatcatattgagtttggagaatattcgtatcaggagataacatcaaaagagaaactgctggaggtattgtcttatctgttgagaataggagatttcagccagtataccgggaaagccgttatcaataatgtttatatggacctgccgggcaagaagcccgtattcaagagaactaagacagcgatgcagaggaataaaatttttgcaacaatcaaaaggtatgcaaataagctaaagccggagtataatggagatgtatatttggaaacggtcagatgttatttcacaataccggaagaaaatttggagaagtgccgatatacatatcagggaaacgaaacatacgcatttctactgtcggacaagtacatcttggggttatatacgcattgtctggtagcaaggaaagaagctgcaagtacagaggtgcaggtggaaggctttacggagaaagagtacggaatggtaagactggagaatgtaggggatgttttgttccaggcgttgttgttcgataacgttaagtttgaagtgaacagaatatatgtggatttatatacaatttatcattagatgaaaggaagatggttatgagcttttatcaggataatatggcaaatttaatgaaagaatttgtaaaatcagttgatgataattttgataaaaaacaaattcaaaatttgacggcttcgcttcaacaatttagtttagctttgaagaaggcaacagaaaacatatccttaaatttttttacggaagagatgcagaattatattgcggaaatgaaagaaagtgagaaattatcacaatcagaatttgaagcaaaatattcatatgaaatagaagtctgtaaaaaattgggacgtgctggttgggttgtttcagaacattcaaatcctagaaaagttaaagaatggtatgacctgttgatgaatcaggatgatactgagataagcacttattttgagggagataatggctgtattttatctaatatctttcgaggtttagaaaagaaatattgtgtagagccaaaccaaaggtattattcaaaagcgaaatgtttttttgagcaagaggattatatgacatcatcaatgtacttagtagctttgcttgaagcgagaacaaatgaattaatgaattatcctaagggaactcggtataagcaaaaatattcagaggaaggttttgaaaatcatttgcaaacagaatttgataaagtggattctttttttactaagagatatctatttttagatgtgtatccttctattatcgaattcttaaatcgtttatttgtagatggtaaatatacatttgaaaacggagtggaaccaccttatattaatcgaaattggcttctgcatggtagaagctacagaatgatcgaacgttatgaatgtatacagttgtttaatgcattaagtgctatagaatttgctttttcattgtctaataagttggatgtagtagaaaaatactaggaggaaaatttatgacagaaaaacatgcttgtatatattgtggaaatacagaaacatcagaatcagatattattccggacgcattgacaaatgcaagaatcacaaataaaaatgtttgcaaaacagagcataataataaatttagtgatttatttgaaagtgacgtaatcgaagcattggcattaataacaaatgaattggacattaaatctcataaaggagagaactatgctgcatattcagctaaaattgaaattgatggtatagaatattcgacgaagatgacatctgaaaaggacttatttaatggacggaaggtcttggtttctacagatggtaaacataaattaagttcaatggacaaaattacaaaaatcgcacaagacccaagtcaaatatctgaggtagacattaataacttacctttgtgtaaaaaagttgaaatagatatcaatgtttactttagcgaaaaaatgttcagaatgatagccaaaatagcatatgaatggtattgttcaagaaatgatgtagttggttatcatgatgagtttgagaacattgtaaaatttattacatctggggagggaaataatccagttacaattttgcaaaatgaggaattatataagtattgcgggaaacaggttagtttgggtagtcattgtttgtttgcctatatagataatgaagaaaaaataaatgtaatagtttcgctttttggaattgcaatgtatcgtgttgtggtatctgatgatattccagcattctgtgaaaacaattttatgtttatggaattaagaacagattcgtccagaaaggaattaaaacatgtttcacgtgaagaggcagaaaactatttttttgagttgcttaaaccaagtaattttatagaaggggcaaatattgcaggaatgcatattatgattcctaaagtgatatctagtatagatgtcgtagtctacccatttgtatttaatatgacaaaatgctttttggaaattaatgatgagacacgagaaccaaatgagagaatagtgaggatattgaaaaataatatacaagaagtattgcaggcgtcaagtttacacaaaaaatcaatacagcgatttgtgaaagagtatttttcagatggtcatgagccaattatacttaatcctaactcgtctaataaaaagactgtgctacttttttatattctattcgttatcggaagggataatatagaacatattgatgacaagtctttacaagacatagcaaaaaaagcattagatatgggagtacaaagtgaacttatcgtgacggatgaaatagaaaagaaattgcaaagtgagatgttagctaccaaaggatatagtgatttgcttgaaaagggagcagaagttataaaaaggtggaacgactagcaagtatataaaaaattaacagcgtcagggcagttatagaccgtaaaggtttatagctgccctttttgcgttcatggacttttggacacgatgtccagtagcggaaaggagagcttatgagatatttactgcacaggctgtatgttccaccatagcagggcatacgcacaggtaacaatgatcggaggtacttatgcaggaggaagtaacacagaaaacgattgctcttgtaataaagatcgctaaattagatgctaacgtgctgaaagctgccatgcggatgtatttgaaccaccgcaggcagaaatcacagaacatgcatggtaagacttctgtgaaaaagctggttggcgagggcgtgggagtatcgtctatcgaagtaactgacagcaacatcaaagcctttgagcgggtggctcgtaaatacaatgttgattttgctgtgaaaaaagataagacctgcgaaccgcccaagtatttggttttcttcaagggcagggatgccgatgtggttgcacaggcattcaaggaatttgtttatggtaatgagaagaagaaaggcagagtttccgtaagggagaagttaaagcgtttcagggatgcagtatcacaggataagaacagggaacggagccgggaaaagaataaagacagggggcatagtctttgagtaatattgtgcagggtatagccaaagacctgaaagctattccggaaaatctgaaagcgaagctgaagggtgctgacaccaagaagctgatgcttttaaatatcccgtatatccttgtcggatatttctgtgacaaagtggcatggctgtggagagtatcaccggggaataatgcttccgataagatgatggcagtcatgaacagttttgataccctgttttccaatcctctgcccagcttccacccaagagacttgatgattgggactggatgtggcatagcactccggcttgtggtgtactacaaagcgaagaatgctaagaaattccggcagggcgttgagtatggttccgcaaggtggggaaacgccaaagacatagagccatatatggattctgtgtttgaaaataatgtccttttgacacagacggagagacttatgatgtccggcagaccaaagcagccgaaatatgcgagaaataaaaatattcttgttatcggtggctccggttccggcaagacacgcttttttgtaaaacccaatctgatgcagatgcactcatcttatgttgttactgatccgaaggggacggtgcttgtggagtgcggaaagatgttaaaaaagggtggctatgcaataaaagtcctcaataccataaactttgcaaaatccatgcattacaatcctttcgcctatatacggagcgaaaaggatattctgaaacttgtaaacacgattatagtcaacaccaaaggagagggacagcaatccggtgaggacttctgggtgagtgcgactcgttcgcagacggtaaaaagtctgcgcacgagcaacggttttccgttgttcggagaactggtagtttgataggtggaatgacggggtaacgccctgaaacgcctacccttgatgggcgtgcattagctgtaatggctggtgtacgaagccccatgacaaaggctgagagtaaccgtaaccactgcctaaagtggtcgaaagcggtctggaggcagactgtgttacctataagccgagagtctataagatacctatggttagaatgttcgctttggcgggcggactgacgaacctgcgaatgtacaggtctaaaagaagaccacgcagaaatgtgtgggtgcgttaatgcgcagtcggtgtggtttagtagaaattgatcctacgaacgaccatgctgtgttacaggcacaggcaagccgacaggtctatagcaggaacctacgggtatgtatgaacagatagaactatcggaacgaggaaaggcagcagattccgcaaggaatagtctgacgaaaaacaataagcagacgaactgctgctgaaaagtagtggtcgaacctatgatgtgcttgcgttatgtgagctacggaggaatggccacaagtcgattgagataagcaggcattattcaatccaacataaggattcgagtaagaccaaaagggtcactttcgcaaaaaggaggtgatgccttatgccaaagaaaaacaaaactctatgtgtagatgacttacgtcatgccgagtattacggtatgcagccagtttttgatgaactctatcatcgaagtttggagggagaaaattttaccgaccttatggatttaattctgagccgggacaacattcttctggcatatcggaacatcaaagcaaacggaggaagctacacagcaggaacagacaacaaaaacatcagtgacatcgggtgtttaccgcccgaaacagttgcagagaaagtgaggtttattgtcacaggaagtcagcacggataccgcccaaagccggtaagacgcaaagacattccgaaaccaaacggaaaaaccagaccgttaggtattccctgtatctgggacaggctggtacagcaatgtatcaaacaggtcatagagccaatctgcgaagcgaaattcagcgacaacagttacggctttcgcccgaaccgttccgtggaacacgccgtgcagaaaacttacaccatgcttcaacgcatgaacctgcattatgtgattgagtttgatataaaaggatttttcgacaacgtaaatcacagcaagctaatgcggcaaatatgggcaatgggaatacacgacaagcagttgatttttattatcaagcggattctgaaagcaccgattagaatgccagacggcactacactcattccagacaaaggcactccgcaaggcggtatcatttcaccgttgcttgccaatatcgtgctgaatgaactggacaaatgggttgagagccaatggcagaaccaccctcttgtaaaggaatacgggtatgagaggaaaatcagaaactcgattacttttgaccggagcaaggcattcctcaaaatgaggaaaacagggttgaaagaaatgtatatcgtgagatatgcagatgatttcagaattttctgccggaataaagaggacgctttgagaacgaaagaggctgtaacggcatggataaccgagaggctgaggttggaggtatcgccagagaaaacaaggatagtcaatgttagaaaacgctattcagagtttcttgggtttaagatacgagtcagaccgaaaaacaggaagtacatcgtgcaatctcatatctgtgacaaaaagttggaactggaaaggcaaaaactggtggaacaggcgaaacgaattgcccgaccttcagagggaaaaagacctttggacgaaatacggctgtacaattcaatggttctgggaatacagaattattttcaacttgccacctgcatcagcattgattgcaggaaaatccacagacaggtcatgacagttttaacaaatcggctcaatacagaaaccgggtgcagacttgttcgagagggcggcgcaatgaccgagagcgaaaaagaacggtttggaaagtcggcaatgatacggtatgtatctggaatcgaccaacctatctaccctatcgcatacatcaagaacaagataccgatggcaaagaaagcggcggtttgcagttacacggtagagggacgggcattgatacacacgaacctaagtatgaactcatctgttctatcaggtttgaggaatcaaccgtctatggggcgaagcacagaacttactgacagcaggatttcactattctcggctcaacgtggaaaatgtgcgctaagtggggaactctttgaaaatgcggctgacatagtatgctggctgaaaacaccggcagaattgggcggcaaggaacgctatcgaaatatgattttgttccataatagatttcttccactcctgcaagagtgtcctaagaatgagctaaaagagatagccgacacgctcaaggcaacaaaggaactgatgttaaaagtgaacagtctgcgccagcaggctggtttgtccgcaatagaaaactaacatttcatttggtgattgattaaatgcttgtgaaaacaaccgatggaacgccggatgcggtgaaagtcgcacgtccggtgtggagtgggggaaaatccggcgataacttcaaaggattacctatcactataggctgaaaagctctattatacggcactcatcgcttatatctggtatgaagctccggaggaggagcagaatttcgccatgctgattgatctgattgatgccagcgaagccagagaggatgatgagaatttcaaaaatgccgttgatttgctttttgaggagctggaggcagagaacccgaaccattttgcagtaagacagtataagaagtacaaacttgctgcgggtgatatatgctctaagtgacttcttaatcatgattttgtcgtggttagtgaagcaatcacttagagcatttttatttcaggaggtacagccatgagaaatgaaaaaattaccccactgtacgagcgcctgagccgggatgatgagttacagggcgagagcaactccatatccaaccaaaagcaaatgttagaggattttgcccgccggaatggactgccaaaccctacgcactttaccgatgatggtatctcaggcacccgttttgaccgccccggatttttggcgatgatggaggaagtggaggcagggcgtgtagaggcaatcgtcatcaaggacatgagccggttggggcgcgactatctaaaggtcggtcaggtcatggaggttttgcggcagcgaggcgttcgtctgattgccatcaacgacggtgtggacagtctgaaaggcgatgacgattttaccccgttccgcaacatcatgaatgaattttacgcccgtgataccagccggaaaattcgctctgtgtttaagtcaaaaggcatgagcggcaagcacctgaccggcactgtgatttacggctacttatgggacgaaaaacgggagcattggctggtagatgaggaagctgccgaagtggtgcgccgtatcttcgccctcacgctggagggatatgggccttatcagatcgcctgcaaattatccgcagaccggattgaaattcctgtcgtacaccttgcccgcttcaacgagggtgtgaaccgttcaaagccggtcaaagacccctatggatgggggtcatctaccatcgtgaacattttgaaaaaacgagagtatttggggcacaccatcaatttcaagacccgcaagcactttaaggacaagaaaagccactatgtttctgaggacgagtggacgatctttgagaatacccatgaagccattatcgaccagcagacctttgatctggtgcagaaaatccgcagcaatgtacggcgttatccaaacggctggggcgaagcagctcccctcacaggcttgctctattgtgcagattgtggcggcaagatgtatgtccaccgcaccaacaatggcaggcggatttctcaatatacctgttccaattataccaaagttccgtgtgggacactatgccctacacaacaccgtatcaatgagagtgctgttctgacattggtttctgacacgctccgggctatcgctgaatattccagaaatgaccggacggaatttattcacaccgttcaggaaacgcaggttgctcaacagagtgccgatatatcgaaaaagcgcaggcgtctggccgctgctcaaaagagagccggagaactggaaaaactgatttgcaaaatctatgaggacaatgccctcggcaagctgccggatgcacgatatagggcgcttgatgcacagtatgccaaagagcaggatgcacttgagattgaaattgcagagctggaaaaggctgttaccggctatgagcagagccagaaatcagcggagaaatttatagccctgattgataagtacgagaattttgacacgctgacaaacaccatgctcaacgagtttgtagagaaaatccttgtccacgaacgcgtccgaaaaggcagtcaggacaccacgcaggaaattgaaatctacttcaattttttaggacgctatatcccaccatccttgcaaccggttcctttaaccccggaggaacaggaagaactgcggaaaaaagaagaacgcaaggacaggcttcatcagaactatttgaagcggaaagccagcggcgcacaaaaacggtatgaggacaaaatcaaggcgaagaaaaaagcggaaatggacgctaagaaagccttgatccgggctgaggatatgaaaaaaggtattttttctactgtcggacagctaccgaaagaagaaccgcgcaaaggcagcatagcagccaacgcagcagtctaatcatcatggagcaaaggagaatgaatatgagtaagttgacttacattcgttgtggagattatgatatacccaacctaaaactttctgtgcagccggaaacttctatcggcaagtacggcaggatgcgaaaatcctacctgaaggaacatcgtcctattctctacaaccaactgctgatgagcgagaagctgtatccgcacctgatagagattgaccggacaacgcaggagcgtatggacaccatgttacctcacatgatggaggctgcgggtgtcactgagggactaaaagcctgtgaccctatgcgttgggtggggctgatgaacacattaacggcacagattgaggaaattttaatcagggaactgatttgcagctgaatgggaggtgcgggaaatgctgacctttgaaaaggttttgaaagtgtttcaggcatatctggatgatgaccctttgtatgaggtggttcagaccagccacggttatacattgatggcatgggaaccccaccggaatgactggtacagcgcagaaatacagaaaactccggaggatttacggaacgctttgttgggtacatacgccaactttctggaagataagattaccggaaatgaccgcgagctgactgtgacagaaaccggagaaatccagcagaggtgccgggaactttgggaaaagtgccgggaaacttgatatagaaatgccagaaggaggccgcgattatgcgtcctccttctgcttcgcagtctgttccattttgagcgccccgtctatggcaccttcgataatcggcaggtattcttcagggcagagtttcagcttgtggctgacccgttgccgctgtgcgctttcttcccgcatgatctccgggttaaaataccgttccacgggaagtccgcagaccttaatcaactggatcatcacaggcaggctcggaatcgcaccttgattctcaatgttggcaaggtaccgccattcaatcccaaccatttctgccaatgtttttcgtgccagacgctttgcctctcgtgcagctttgacatctgcgccgaaggtttcaaaaccgggacaatcttcaactttcgccatataacatcacccagttacattgtataattcatactttgcccgtggaatgtcgctatatgcaggttggttgaagtttataattcatatattacatcttatatttttcaagaacaggaattacaatagaagggaaatgaaaaaagtaaaagaaaaatttctaaagttaaatccttttgggttactcagttgtatattaagtgtaaggcgttttacacatggaaggcggtgacacggtatcgaagatttcatactaattaaaaaaatccagtcgggtgacacagatgcatttgagataattgtccgaaaatattatcagtcaatttatctattttgttgtcggcgattgaacggcaatccagataccgccgcagatattacacaagatgttttcttgaaattgttggagaatattcaatcagtacgaaagatcgggaaatttcaaaactacctgctaacgattgctgttaatacctgtaacaattatactaagaaagcaaaacccctgtatatggatttagaaactcttgaagatatagaagatactgataatgcctttgaaaaaattgagcttaacgaacttaaagcgcaaattcaatatgcaatcaacacattaccggactatcaaaaagaggtcatcattttacgattttattatgatttgaaaatccgagagattgcaaccattacaaaagctagtgtttctactgtaaaatctaggctccaacaggggattaaaaaactggaacgatatttggctgattttagaggaggcgataatgtatgacccaaaaacaaaatggtgtattagaatggttgcagagttgtgaaacgcctgctccatctgaacctaaaattaaagcagtaatcgtagctggaaaaagttacatgaatagttctgaattcaataaaaattcaatgcgagatattatattgaaccaacttcaatttctgccgctttctttctggattgttcaaataatactcactatatgtgcagtattattagcatgtatcctgggccaatggagggttccattttattatccattgacaatccttgcagttatggttccattccttgcgttattaggtgcaatagaaatatctaaaagcaacatctatggtatgtgggaaattgaacagtctagtagaacaacgctggtaaaaattgtagcaggtcgtatgctgattattggagtaatcaaccttttcctaataacagtcattttaatttcaatggcatatatttaccagaaatcaatgattgaaatggtgttgtatggtttgattccatttaatatttcttgcacttgttatctttttatatgcgcgaaaagcaggacaaacgatagcttgtatcatttaatcgcttgtatgatttttctttctggaacattttctcttgtactccatcagcgatttatatttgaagcgtctatgttctggggatggattggattttatgtgttatctattatcctattagggaaaacacttcaactgtacttgaaaaaagaaaaaatgattggagaattgatatggaacttacaataaatgatctttcaaaagaatatggaagaaaaaaagctgtaaatcatttcagcgcaaaattaacaaatggtgtttatggtctactcggggcaaatggtgcgggcaagacaactttgatgcgaatgatttgcgatgtccaaactgaaacgaaaggagccattttttttaacgggaaaaacattcatgatttgggcgagaaatatcgtaatatcttaggctacctgccacaaaattttggctattatcctaactttacagcgtataaatttttgatgtatatctctgcaataaaggggctgccgcctaaaaaagcccataatcgcacaatggagctgttgcaggttgttgatctgctcacacagaaaaacgaaaaaatcaaaactttttccggcggtatgaaacaacgcttgggaattgctcaagcattactaaacgatccccgtattttgattttggatgaacctacagctggacttgacccgaaagagcgggtgcggtttaggaatctgattagttctttggcagaaaatagaattgtaattttgtccactcacattgtttctgatgttgaatatatcgcaaatgagattctgattatgaaaaatggcgagttaattcaacatggttctccagaagaaattttgaagccgattgaaaaatgtgtttgggaatgtgatgtatctcgaaaagaggccgaagaattagaattgaactatgtaacagcaaatctgaaacataataatggtgcagaacggctgaggattatttctcaagaagcaccatgcagaaccgcttggaatgttgatccaacattggaagatttgtatttatactattttgcggaggtatccgagcatgaatgaaatgataaaagcagaacgaaataaaatatgttcgagaaagcaaacacgaatgttgtttttagctggtatggttcttatcgttgcctattttttcttttttcaatttaattatcaaaatgttttctatgattatgaccttgaaaaaatggcattagcaagcggttttacagccattgaacaacggaaggaagtagcagaaatatttgaaggaaaactctctcaaaatacattacttactatgcaagaaaaaatcgaccaagcaaaacaagcaactgttggacaagatgaaaattctgctttttctgctgttcatgtttatcgtgaccaagcggcgattctggaatatttgacaaattctgatggtagttttaagtcactcgaaacagcatatccaaatagtccaactgtgactttaggatattgcgatggctgggataagctattatctggaatggggagcatcttgtccataatgatatgtttaattgttgtaatcactctatctcctgttttctcagaagagtatgcacttcatacagatagcattatttattcggctcggtatggccgaaccaaactcacaacttcaaaaattatagcggccttggaagttgtaattggcacatacctcttgtatttactgctaaatttagttctgtatggctgtacctatgggttacaggggtggaatgtaagcattcaatcttcattacattatgcttcttcaatatataatttgacctttttgcaaatgttctttatctctgtaatattgaatatttttgggattgtagccttgacaactattacattgtttttaagtgctcaaatgagttctcctgttacagcgcttattacttcttgcgtcatctgcttcttgccagttgtgtttgattttaatgatagccttcctgttttacaaaaaatgcaggaaatttgcccgatttttatgcttcatacaaacggtatattttctgatatgaaaacatatttcggtatgagccagccggtctttatgatcatccttaatgttggattgatattcgtattttatagactaacaaaaaatatatcaaagaaacatcaagttacggggtaattttgatgaaagagacaagttgggttagttgtcctatatgccataataaaacccgaataaaaatacgaattgacacggaattaaggaatttccccttgttctgtccaaaatgtaaacaggaaacgctcattcatgtaaagcaactgaatatatccgttattagagagccagacgcatagacgcagagccgataacacgcaggctaacatgactgctgttatcggcttttcatattcttttaaacctgccccgcctaatggggaaagaaaaaaaccgtagctgggcaggttgattttgtgcgcttactctagataccctggcggcggttttgagaaatcagagccgccgtttcttttcgtctaccctaaaccaacgacgacccaacaccgtgtaaatccacggcggcatataggaggatgccgccgtgtctatgtttgcgtcttttcacagtatccatgatctgcaccacttaaaaaaagcctgttcccagcagcggagcaatgcggtcagaagtatgcactataccatgtaactaaacagcaaaatatactctattacgctcgtatggctttatgccgtccgggcgcttttttgtccctatggagccggaacatcgggtcagcatggcccgaactttatccccggtgccgctccccgccgcctcattcagatttaccaaaaaatctgaatggaggaaaggcagatggaagttaccatcaattataacggacaagctgtgaccgtggaggtcacgctggaagtctatgaatttcttgaccgcgccgatcacaagacggaaaaccttgcccatgaacagcggcggcattgggacgggcgggagtttgacgagtacatagcttttaccgagggcgtgggcgtttacagcgaaacgccggaggaatacctttgccgcatggaaacgctgcatgatctgatggctgttctggacacctgtaccgaggcccagcgccgccggttcctgctctatgcgcttgacgggctgagccttgcggagatcggtgtgctgtgcggctgctccaaagtagctgtttatcaaagtgtggaggcggtcagaaaaaaatttataaatttctttgagaacaggcttaacgaatgacctgttttctggctaccaagtgaaagggatcatttcccttatctcagcgaggggcggacagcggacgagctgtccgcctctccgattttcaggaggtaagcctatgaaaacaatcaatctgcggtggatgtatccccactaccggcatgacgagtttgtggatgttacggacgaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgattgcagctctgcctgcggctctggctcatgccactccgacacaggcccgccgtgttcacgcctactacattgccggtatcaagcagccggaaatcgcccggagagagggtatccatagcagtaaggtcagcgttgccatccaccgggggctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggacaagagagccgaggccgccagagatcgcaagatgttccggtataaggcgttttattccctcgattgtaacgatggaatcgaaaatgccgccatcggctgggcgcagccatctccggaggactacctgatagaaaaagaagaattagccgaatatgaagaactgatacggcgattgtacgaagccatttcttccctgccgcctatgcaggctcgccgtgtccacgcccgctatatgctgggtatgaaagtgaaagatattgccgcaatggagggtatcacgccatcacaggcgggaaaatccatccacgctacactgcgaaggctgcgccggtactttgcgcgtcagaaatggacggtcaatctatgagtatttccaaagaaaagaggtgcatgacatgaacgaaaaaaatacagcccacccccaaaaagaagaacgggagaaagtcctgaaggagatccggcagcttgaaaaccgaaagaagattttggagaacaagcagcggaacgaagaacgcagggttcgcacccgccgtctgattgagcgcggagccattttggaggggatttttccgctggctcccaacctttccagcgcagaggtcaaagcatttctgattgccctgtcccatcttccgggggctgcggaattgactgcaaacctgccaaaatccggggacacgccataagtcccttgtttacaagggcgcacttatacaccgttgccggtgctgtgcgccctgccgggggcgttgcgtacttcgtccgcgatgggaagctacgctccccaaaccccttgtgcgctctgcgcagccaaacacccgctttgcgtttgtccggctccacagagcctgttatcccctcactgaaaggaggtgttccccatagatttctgtcatatccccgtcagtatcatcaagcgcagcgcgggccgttccgctgttgcctcagctgcttaccgcagcggaaccaagctgacaaatgaatgggacggcatgacccacgactacacccggaaaggcggcattgttcatgcggagatcatgctgcctgcccacgccccgccggaatttgcagaccgttctatcctctggaacagcgtggagcaaatcgagaaagcaagggacagccagcttgcccgcgagatcgaagcagccctgccccgtgaactatccggcgaacaacagcttgcccttgtgcgtgcctatgtgaaggacaactttgtagacaaaggaatgtgcgccgactttgccatccatgacaagggaaccggcaaccctcatgtccatatcatgctgacgctccggcctctgaaagaaaatggacagtggggcgcaaagtgccgcaaggcatacgatctggacgagaacggacagcgtatcccggatgggaaaggcggctggaaaaatcatcgggaggatacaaccgactggaacgataaaggaaatgtggagatttggcgggcagcgtgggcagcctacaccaaccgggcgctggaatctgccggtagaccggagcgcattgaccaccgcagctacaagcggcagggcattgataaaatcccctctgtccatctgggaccagccgccagccaaatggaaaagcgcggtatctgcaccgacaagggagaagtaaaccggcagatcgccgccgacaacaaactgttgaaagaaatcaaagcccgcattactcggctttatcgctggtcgaaagccgaagcggaaaaaccacaaacgcagcaaagcagcttgaccgccttgtgggaggcccagcagcagttgaacgctccccgcacccgcaccggaaaaatccgggctttgcaggaaagcgctgcactattcagctttttgcaggcaaacggcatccagtctatgcagcagcttcatgaaaaaatcgctgatatgaacagccgttactatgacctgcggggaaagatcgtcaaggctgagcgccggatcgccactcttaccgaacgcggggagatgtgggaacagtacaaccagtacaagtccatccacaaacagcttgccaaagtaaagccggaaaagcgggaacagtttgagcagcgccacagccgggaactgattctgtatgacgcagcgacccggtatctgaaagaactgaaagacaacggcgaggcaatcaccccgaaggcatggcagctggaaattgaccagctggccgctggaaagcagacggacacgcttgccatgaaatccatgcgggaggatttgaaagcagtggaacggctccgcaaaaccgccgagcagctgtcccgacaggaaagggacaagcctcacgaccgtgggccggagcggtaaaggctaccgcgttttggcgtacccctgtcaagtgcgtcgcatttcacgacatacttttgcacacagaaaaaccgccgtacaggtttccccatacggcggcagactgtttatttgccgaacaagtcgctgtgtgtgccggtgcgggccagcgtcagcaccagaacatcatcttctatgcggtagacaagcagccagtccgggagaatgtgacattcccgatggcctgcccaatcgccggacaggtcatggtcgcggttcttatccggcagcggttcgcccattgccagcaatgctacggcctgctccagcagttcgatcttcaagccacgcttgatggctcgtttgtagtcttttttgaaactggtcgtgtacttgacggtatatttggtttctttcatcttttcaggtcagcaaacaactcgtcaaggtcattgtagccctttacagacgggtcttttgcaatcctttccgcttccagcatggcagcaaccgtttctttgttcggctgttccagccttacttcaaagggaatgcctccttcacgaagcgactggcgcacaaagatgttaaacgccgtagtcagattcatgccaagttcagtaaacagtgcgtccgcttgcgctttcaaatctgcgtccatgcggatactgatgtttgtggtatttccagccatacgatcaacccctttctactggcaattatagtatatgccatttgcacgaagaaaacaatactttgcacgaatatttaacaataaattcattcaaggaggttacctgctttgtgaaagaaatcatttatgaagaacgacaagactgaacctatccccgtcatggattaccgccagtaccgcagagcgcggaggctggtgcatgagtgctgcaactacatcgacggaaattgtatcgccctggacgatggggaggaatgtgtctgtgtccagtctatttcctactccctgttgtgcaggtggtttcgggcggcagtattaccgcaggataaggaactggaaacggcgctgttccaccggctgaatgcgaagaaatgcgccgtatgcggggcgctgtttacccccggttccaaccgggccaaatactgcccggaatgtgccgcacgcatgaagcggatcaacgccgcaaagcgcaagcggaaacaacgggagaaatgtcacgctttaagggctgaaaaacccttgtaaatcaagggttttttcgagggtatcaaaggcaggctgatagatttatcctccgacccctaaaacggtcttaaaatgcgtacagaatcccaagagaaaccccaaggaggaaccctatgtcagacaaccgaaaatattattacctgaaacttaaagaaaactattttgacgatgattccatcgtgctgctggaaagtatgcaggatggtgtgctgtattccaacattctgctcaagctgtatctgaaatcgctgaaacatggtggacggcttcaacttgacgaggacattccttacacggcgcagatgatcgccaccattacccgccagcagatcggcactgtggagagagccttgcagatctttttgaagctgggtcttgtggaagtgctggacagcggcacattctacatgagcaacatcgaacttttaataggccagtcctctaccgaggccgagcgaaagcgggctgcaaggcttcaaaataaggctctttctgcgccccggacaaacggcggacatttgtccgacattcgtccaccagagatagagatagagttagagaaagagatagatataaagagagagatagagaagggacgctccgcccgcgcctatggccgttaccagaatgttttcctgacggacgaggaactggcagacttgcaggccagttttcctgttgtatgggaacagtacattgaaaagctgtccgagtacatggcttctaccggcaagcgttatcagagccatgcagcaaccatccggcgctgggccggtgaggacgctaaaaaaactgtcacaccctcacgcaaccgggattacagcgtaaaggaggatgaaactgtatgattgagattaccgcagaaatccgggcgttcatcgacaaggcagctgccggtgtggaattggctgaggacgagtatatagacccgtcagatgggctcattcactgtaagaaatgcggcggccagaggcagaccgttgtgccatgctttgggaaatctggctactttatgccgcgctgcatctgccagtgccagcgggaggctgaggagcagcgcaaggctgctgaagaacggcagcgccgcatggagcgtatcaaacgccgaaaggcacagggcttgcaagaccgttatctctatgactacacattttccaatgataacgggcaaaacccattgatggacaaggctcacgcctatgttgagaactggaaggaggcatataaaaacaacaccggcctgctgttgttcggggatgtgggaaccggcaagtcctttttcgccggttgtattgccaacgccctgcttgaccgggatgtgccggtgctgatgacgaacttccccaccatcctgaaccgcctgacggggatgttttccgaggacagggccgactttatcgccagctttgatgagtacgacctacttatcattgacgatctgggtgtagagcgcagtaccgaatatgctatggagcagatgtttttcgtcatcgacagccgctatcgcagccgcaggcccatgattatcacaacaaacttgaaactgtccgagctgaaaaacccgcctgatctggcccacgcccgtatctatgaccgtattttggaacggtgtgcgccgattctttttgacgggaagaatttcagggaagaaaatgccggtgctacccgacaggcagcaaaagacattgtaagcagtaagcacgactgattttttaccgggcggcacagacccgttcggagaaaggagcgccatgaacagagaaccccgtactatgcaggtggcagacgccgctactgcgtccagagcgccggaaaacacgccagcgatggtaaagaaaatcggtaagacaacctacaaggttcatgtccatttcagcaataccagcacagaaaccatgagcgataaaatcaagcgtatgctcaaaaatgaaattcagcagatgtgatagactgataaacgaagccaccttgtgctaaactgatgatggtacgcaccaaaatttttgtcaaggaggacacgaaaatgctttacacagaaaaagagaagcatgaaattgaacgagtaaaggaggtctttgcggaacatctgcggcaaagccctgattttgaactgctctggtcggacaaggtaggctatgtttggctggcgattggcgtaaatccgctttatgtggataccggtatcaggatagaatcagctgccgatctctgcggcaggtgtttggacgatgttgctacggatgttttgtatatgacgggcaacgatcatgcactggaagtagctgacccgctggaattagccgaaatcaagcggcgctgggagccatatatcaaccagctgccagactatgcgtatctctgcaaagacctgctgaacggaaaaatgtaatctatcaaacgaggtgtcaggagccatacggtgcttctggcaccttttttgtggatttttgtgaatttgatgaaaaagtccttgacaattcgtctctggaaagacagcaaaatccatattgattagctgtggtgcaagactggcaccttttgacattaaagagctgcgtgacctgatggaatatgacgagctggagcttgatacgattggtgagaaaaagacagcgttattcgtcattatttccgatacggatgccacatttaatttcgtggtgtcgattatgtattcccaactctttaacctgctttgtgacaaggcagatgatgtatataacgggagactcccggttcatgtgcgtatgctccttgatgagtttgcgaacatcgggcagattccacagtttgagaagctgattgctacaatccgtagccgtgaaatatcagcttctattattttgcagtcaaagtcccagctcaaggcgatttataaggacaacgctgacacgattgaaggcaactgtgataccacactattcctcggtgggaaggaaaagactacgctcaaagaactggcagaagttctggggaaggaaacgattgacctttacaatacctcggatacaagaggtacaagccagtcctacggtctgaattaccagaaaaccggaaaagagcttatgagtcaggatgagattgcggtcatggacggcggaaaatgtatcatgcagcttaggggcgtgagaccatttttctcagacaaatttgatataacgaagcacaaaagatacagggagctgttcgattatgaccctcaaaatgcctttgacattgagaaatatgtgaagcatctgcatcacatgaaagtcactccaaatacacaggtggatgaaacctttgactgtggggaggtaaacgggcaggaggagcattcctcaaatacaactgaataaagaaccatgaacctttggacacaatgtccagaagcaaaaataatttaagaaaagaaagaggtaaattgaatggcattttttacaacagcagtaacaggacttaaaacagtagtaaccgcaatcggtgcaggtgtggcagtatggggtgtgatcaatcttctggaaggttacggaaacgataatccgggcgcaaagagccaaggagtcaagcagcttatggcaggcggcggtattgttattgtggctcagacggtgattccacagcttacaagtctgttctcataattcatgggaacaatcattgacaaaatcactgaatttataaaggaaatgctgcaggggtgggtgcttgacaatcttgaaacgatgtttaccgacgtaaatacgaaggtaggctctattgcaggggaagtcgggcagacacccagctcatggaacgcaggcattttttccatgatccggaatctttcagataatgtcatgattcccatagcaggaatgattatcagcgccatactctgctatgagctgattacgatggtaatggataaaaacaacatgcacgagatggggagcgagttcttctttcgctacctcatcaaagcatgtgttgcggtaatgttgctcagtaagacgtttgacattacaatggcaatctttgatgtgggaaaccatatcgtgaccaatgcatcgggtgccattaccggctccacgagccttgatgtgtcatccacgttgcagaccatgtttaatgatcagctttccactatgggaataggcgaactgatagggcttggaattgaaaccatgattgtcagcttatgtatgaaaatcatgtccgttttaatcaccgtcgttttgtacggacgaatgatagagatatacctttatatttcagtggctccggttccgtttgcgacgctcagcaaccgggaatggggcagtatcggcaacaattacatcaagggactgtgtgctctggcatttcagggatttttcatcatggtgtgcgtaggcatttactctgtactggtgtcgagtgtggcggttgtatccaatcttcatacggcattatggtcagtggcagcctacaccgtcattttatgcttcagcttatttaagacaggctcccttgcaaaatcaatacttaatgcacattagtaggaaaggaaaatgcttatggcaatatcagtagcagtgccaaaagatttaagcggcatcaagacaaaggtggcgatgaatttgacaaaacgtcagttaatctgctttggtggtgcgggtgctgtgggtatccccttttatatttttacaaaaggggcaatcggcacacaggcatctgcattgctcatggtggcagtcatgctgccgtttttctttctggcaatgtatgaaaaggacggctttccggctgagaagattctgtactttatgatacggcagaaaatactgacaccgggaatacgtccctataaatccgaaaacatttacaggcagttggaggaacgggagaaaatagagaaggaggtgcgttatcttgaagaaaaagccgcaggcaaaacaacagggtaaacctgtaaaagcgggcttgaatttttcagaaaagaaaaggcttgcagagctgaaacgtactcttgcaggaaatgacaaaaagcaggaaaagccaaccacggcacagaatacgattacttttaaaaagatgttccgtgacggcatctgtcaggtgacttccacctattacacgaaaatgttggagttcttcgatatcaactatgaccttcttgagatagaggatcagggagagattctggaggagtacagtaaatttatcaattattttgacccgtctattaagttccagttatttctgtttaacagacaggtaaacgaacagactttaatagaccagtttgacattcctttgcagggagatgattttgatgatatccgggaggaatattcggagatgttaaagaagcaggctgcaaagggcaacaacggcatcattaaatcaaagtaccttatttttggtacggagtgcaagggctttaaagaagcaaaatcaaagctgaataatattgaagctgatgtgattaaaaattttttgaatcttggcacacacgcaagaagcctcgacggaaaggaaagactgcgtatcctgcatgaatatttcaaccaggatacaatggaacctttccgtttttcatttcaggaactgtcagagtctggaaagagtgtaaaggattatattgcaccgccgggctttgatttccgttatccgagccgttttaagacagggaagatgtacggctgtgtccactatctggatattattgcaccgaggtttaatgacgagttgttaaagaagctccttgacattgatgataacttaaccgttaccatgcacatgcagacaatggacccggtaaaggcaatcaagatgttaaaagcagctctgaccaatatccagaaaatgaagattgaggaacagaagaaagcagtacgttccggctatgacatggatattctgccaacggacattatcacttacgagaaggacacgctggagctgttggatgacctgaatacaagcaaccagaagattatcaagatgacctttcttattacctgttacggcagaaacaagagggagcttgaaaatctgattcagagagtatccggcattatccagcaggcaaactgcaatttgagatgtatgcagtatttgcaggagcagggccttatggcatctgcaccgattggctgtaatgatacgggtattgagagggtgcttaccacaaagagtactgctattctggtgccgttctgtacgcaggagttattcatgcctgccccggcaatttattatggactgaatgccttgtcaaacaacatgattatggcagacagaaaaaggcttcgtacaccgaatggagtcatacttggtacacccggttcgggtaaatcgttcagtgcaaagcgtgagattttatcctgctttttaatgacaagggatgatgtgattatctgtgatccggagggagagtattttgctcttgtgggagccttgcatggacaggtggtacgacttgccaccaattccaaagattacttaaacccgatggatatccagttaagtcataagaacgataaggaagcactgaaattaaagagtgattttatcattaccctctgtgatctgatcgccggaggaaaggatggtctggaaaatgatgaaaagggtattattgacgagtgtatccgtcatatctacgatgcttattttgaaaatccggtgccggagaacatgccaatccttgaagatttgtataatgcccttctggaacataagaacagcaaggcagaacgtattgccaatagccttgtgctgtatgtgcatggttctcaaaattattttaaccaccgtaccaatgtagatagtaagaaccgcattatgtgttttgacatcagggacttgggaaaccagttaaaagagcttggaatgttaatcgtgcaggatgcggtatggaacagggtatcgcagaacagggagagaaagattgctacccgctattactgtgatgagttccacctgctcttaaaggaaaggcagacagccatttattctgtggaaatctggaagcgtttcagaaagtggggcggtattccaacaggtctgacgcagaacgtgggtgactttctgaaatcagaggaaattgagggtattcttggtaactccgattttgtatacctgttaaaccagaacgcaaaggatcagacaatccttgtagataagctggggttgtcggaaaagcagcttgcccatgtgactaattcagagccgggttccggtcttatcctgtttgacaatgtggtaattccattcgtggataaatatccgacagataccaagacctatgcgattatgaataccaaaccggaggaaagtgtaaggcaggaggaaaataattagtggcagagaaaagaaagaaacagacggctgtgtttggcacaaatcagccgagagatgaaaacagagcttttggacacgatgtccagaggtcggaacagaaacaaaagtccggaaaaaataagcgaaagacaggtcagtaccggaaagaggatacctttggacagagagaccagaagtctggaaatacggataccagtaagaatcagaaaagtgatttttcacaggaaaataatgcttttactgaggagaatgtttccgagcaggagaaaagccagccacaggatgattaccaccgcagggatacttaccaccaatccgaaaaaaaggggaaatatcgtaggcgggaatatcaggacaggcagagaaccaggacttctgattttgagcatgactttcagacaaaggacagcacttttacggagagtgaaaggacagagtttgaaggaagtaaaaagttagacaggcttcagaaaaaggcagaaaaagccgggagaaaaacagaagcggcaagaaagaagattccgaagaaaacagaatattcccttgagcgtgtttttgatgaaaagacaggcagggcgaaatatgttctaactgcggataaaaaggaaaagcagtttaagccggacaatcccgtgaaagtaataacaggcagggcgggtgcagaggttttcaactttacgcatggcaaggtggctgaggtggaaaaagaaaattccggagtagagggcgcacacaagacggaacagaaagccgaggatgtgtaccattttgtaaaacggcaccataagagccgattgcagaaacagcatgagaaagtgaaaaagctggagaagaagcagtttcagaaagaggtcaaattccgttatcagaaataccttgaggaaaatccccaaatgcaggaaaagaccttaaaaaagcaaatacagaggcatttgcagaaacagcggatcaagagggagtatgcaaaagcaaggagggctggacaggcagcaaagaatacgaaggaagcggcagcaaatacagccagttttacaacaacagttgcaaaaaaggtgcaggaacttgcagcaaaacacgccggactgcttgttaccataggcatttttgctttactgctggttatgattatgatctgcatatcttcctgtggtgcaatgttttcggagggtatgagtaccacgatggcaggcagttacatgagtgttccggcagagattgatgcagcagatttagctttttctgagctggaaatggaattgcagaaagaaatcaatgccatagaaacagattatccggattatgatgaataccgctacaatctggatgctatcggacatgacccgtttgctctgattagttatttgtcggcagttcatacggaatttacagcggcagaggtacagagcgaggtggaaagcctgtttgatgagatgtatgagctgaccttaacgccaacaacggaaacaaggactcggacagtgacaaagacaggaaccaggactgtgacagacccggtaacaggagaagaaacagaggaagaatatgagtatgaggaggaagaagaatataccgtaaccatacttgatgtaacactgacagctgtggatttaaatgtggttgtggcaggacacatgaatgaggagcagaaggaaatttatgctctttataatgaaacacatggtcttgtccagcagttttatacaccacttgatttgtactggtacaactatgtgagcagctattatggctatcgtatcaatccggttaccggagaggagcagttccaccgtggtgtggacattgcagtaccgacaggtacgcaggttcttgcatctatggatggtactgttacaacagccacctatgatgcttcttacgggaattatgtggtgattgaaaaagatggttatacaaccaagtacgcacatatggacacgttaagtgtcagtacaggacaggttgtcacacatggaacggtcatcggaacaacaggaaataccggaagcagtacgggaagccatcttcatatcgagtgtctgtataacggggagtattataacccgttattttactttgaagccggggaaggaacactgtacggagaagcaccgggaagcggaagtggcggaggaaatgcaataccgccggattcttatgatgatgcaacggtgcaggcacttatggaagaagccgcaaaatacttgggctatccttatgtatggggcggttcgtccccgtcaacgagttttgactgttccggattcgtgtgctgggtgtttaccaacagtggtatccatgatctgccacgaaccacggcacagggcatttatgaccagtgtactcctgtttcggcggcagatgcaaaggcaggggatattatcttttttaccggtacttataattcaccgggtcctgtcagtcatgtaggtatctactgcggaaacggtgtgatgatacactgtggcgatccgattaagtatgcaaacatcaatacatcatactggcagagccatttttacagttttggaagattaaattaaccataggaagtgaggacaatgacaaaggaaagaattgaaaaggagcttacaaaagtccgggagcagcttgcgggactgcaggcaagacaaaaggacttggaggagcagttgcagatggcggaggatgcggagaagatgaaattcattgaaaaaaataaaatctctctggagcggctgattttactgaataaggtcagcgaggaggaaatccggcatctgttaaggaaaaaggaacaggaagaacagttacagaaatcagaaaagggggcagaatgccatgaagaaaaaaatgaagttatcttataaagcggtgttatcgcttatattatcagcagtattgttctgtatgcctgctgtgggctttgccatgaacggaaactatgctacggaggttcatgccgaagattccaccggagagaatgagacagcaacagagggcaacacagagcaggagacagaaagccctacggaaagcagtacagagcaggaaacggagagtacggtatcagggaatgatgtgccggagccggtatgtatctgtgaggataaatgcagttcttacgattatgaccatacctgtgaggtatgtgccggggattacaaaaaatgtgcttataaaaagcctaatgttaccataaacatcaacaaaccggatggctggtacaacgatactgcaaaagtcagcatttctgtatctgatgtggcacacacaggcaattttgagattgccagtatacaggcaaaaatcgggcagaatggaagctggatggatgtaactgaggacagaaaacttgagatttccgagaactgtaccgtatatgtgcttgtcacagaccagaagggcaatacctatgaaagatgcaggacaatcaaatgctttgatacgacaaaacctaccttaaatgcggcagtcagtgacggactgttaagcatacaggtacatgatacggattccggtgcaaaagcagtctatgtgaatggatatgaatttacagacctgacaaacggaaccttaaatatccgtctgcaacagtttgatgcgggatatgagtattttacgatttccgctatggacaatgccggaaatatgtctgaggtttacaagacaaagaatccatattataaagaccctgccgatgacagtgacgaaaatccggcagaacagcttccggtcagtgcggaagccaccaagccgggaaatgccacaggaacagttacagagcataccgttacagacagtaacggcaacactacttcacagaccagcctggcagatcagaaaaagcaggcgatggcagaagcggatgctgcagaaaagggtgaggatacaaaagcggagtccgggcagggcaaggaattttataccattcagactgcatcggataaagtgttttacctgattattgacaggaacggagaggaggaaatggtttatttccttacagaagtaacagaaaatgaccttctcaatacaacttccgataatagtgagactttaccgaaaaattcagcagcactggagtctgcaattccgacagaggagagcgcactgccaaacaataacagtggtgcagaaacagagcagaatgaggaaacagaagataccggggaaatggagaatacggaaagcacagaaaccgcagaaccggagcaggaggcggcagaggaaccgaatcctatggtttcctatgtgcttatgggtgttcttgcagtagcctttatcggtggagcatattattttaaggtagtacgcaagaaaaaagaggacttcatcgaggatgaagatgaggaagaagatgaagaatacgaaaacgaagaagaagcggaggaagtttccgaagatgatttctttgacgagaaggaggacgagtaaggatgcagttggtaatagcggaaaagcccagcgtggcacagtccattgcaggcgtaatcggggcgaatgagagaaaagacggatatatggagggaaacggatacattgtttcgtggtgtgtagggcatttggttgagttggcacagccggatgcctattttgatgcatggaaaaagtggagctatgagagtcttcccatgataccggaacaatggaagcatgaagtaaaaaaggatacagcagcacagtacagggtgttaaaggaactgatgcatgaagcgagagtggatagtgtggtgtgtgctaccgatgccggacgggagggagagcttatcttccgtctggtttatgaaatggcaggctgtaataagcccatgaagcgtctgtggatttcgtctatggaggaaagcgcaattcgggagggttttgcagaattgaaaccgggaagcgattatgatcatttgtatgaatcggcactttgcagacagcaggcagactggcttgtgggattgaacggtacaagactttttacggtgctttatggcggcaaggtcttgaaagtgggcagggtacagacacctacccttgccatgctggttgaccgagaaacaaagattatgaattttaagaaggaagcctattacatggcacacatcattggtggtggtgtggatgccgtcaccgataagataaacagtaaagcagaagcggagaatgttgcaaatatctgtgcaggtggtcaggcacttgtcacatcagtattaaaggaagaaaaatctgtggcaccgccaaagctctatgatcttaccacgcttcagagggatgccaaccgattatttgggttcaccgcaaagcaaacattggaatatacccagagcctttatgaaaagaagctttgtacctatccgagaacggacagccagtatttgtccgatgatatggagcagactgcaaaaagtgtgattgatgcaatttttgcttccattctatttgaacaaaatatcatatttcatccggatattaagcgtgtgttaaacagtaagaaggttacagaccacaatgccattatccccacaatggagataacaaaggcagatcttacggcattgccggaaacggaaatgaaaatcttatccctgtgtgctactcgtctgttgtgtgccaccggggaaaagcacatttacaacacaacaaaagcggagcttcgatgtggagatattacttttaaggtatccggaaaagaggttgtgagaaatggctggaaggactttgaggatgcgtttaagcgttcctatagaacaacagaggaaaaggatactgccgatgaaaatgagaagaagctgccggagctttccgaaggaatgaacattcctgtggaggaaacaaaggtaagtgaacatttcactgcaccaccgaaacactttacggatgtgatattttgtgagcgtaaggagtggataggaattgaagaaaggagttcagcatgagaagaaaaaaagatagaagcaatggcattactgctttgtatgaaagactgtctcgtgatgatgataatgctggagagagtaacagtatagttcatcaaaagcaaatgcttgaagattatgctatgaaacatggttttacgaatcttgttcattttaccgatgatggttggagtggagcgacctttgacagaccttcatggaacagacttgttgaaggtgttaaaaacggagaaatcactgcctgtatctgcaaagatatgtccagaatcggcagagaccatttgcaagtaggttttttcactgacattctgtttagagaaaaggaagttcgatttatagcaatcaataatggtattgacagtgaccgtcaagaaaccagtgagtttgccccttttctgaatatcatgaatgagtggtttgtcagggacacaagtaagaaaattaaagctgtactgaaatccagaggttcttccggcaacgctcatacaagtaatatcccaccatacggctatttgaaagaccccgaaaaccccgaccattggattattgatgaagaagctgctgaagtagtccgcagaatttatcgcatgactattgagggaaaaggaccttatcagatagcaagagaactttcagaagaaaaaattgaaagaccatcttattatcttggcaaaaagggacttggaaatcatgcaagcaactatgacaaagaaaatccgtatatgtggcgaggaaatcaggttactactctgattgcccgaccagagtatatcggaaagactgtcaatttcaggacattcaaaaattcctataaggacaaaaagacgaaaagggcagataaggaagattgggtggtttttgatgatacacaagagcctattgtcgatgaagaaacatggctgcttgctcaaaagttaagacagaatgtaagaaaagcagatcctatgggcgagcctaatgttctgaccggaaagatttactgtgctgattgtggtgcgccgatgtataatcacaggcagcggaaagggcgagaaagaatatactatactgccaaaggcgaaaaaaggacaagttattccaatccggcagattgttatgaatgttccacatataatcttgcttatcagaagtatgaccgacattgtacttgccaccatatttcaacaaaagcacttaaaagcatcattctgaaaaccatacaagagacttgccattatgtttctttgaatgagcaggagtttgtctattctctgcaagaagaatcggcgatgaaagatattgctgtttctgaaactgtaaaaaaacgcattgaaagaaatcagaagcgagttcacgaactggatatgctcatcaggaaaatctacgaggataatgtgattggaagattaccggacaggctttttcagagtatgcttactgattatgaaaatgagcagaacgagctaaacaagattattgagactgacaccgctgatatgcaacggattataggcggtcaaaataatgtggagcgttttctaaagctggttaaaaagtatgagaatattacagaacttactcctgccatgataaatgaatttatcgacaaaattctggttcacgagccacaaggaaaaggtgcagaccgcaccacagaggtggagatatatcttaactatgtcgggcaatttcaagtacctgtggagcagcatgaaccaacagaggaagaaaggattgctgctgaaaaagaggcggaacgacttcgcagaaaacgagaatccaatcgtaagtatatgaaaaagattcgtgagaaatcaaaagaatttgctgaacatgagcgtatagcagaagaaaataattttgatagcaatgtgcgtgtcgaacagaatgccgcaaccaaatcaaatcggcaaaaagtgaaaggagaaaaaatagcatgacagaattgaaaccacgaatccatgacaaaagcaacggtctggactatgttcttgtgggcgattactatgtgccggacttgaagccgccggaggaacaccgccctatcggtatgtggggcagactgcacaggacatatttggagcagtaccgccctacaaggttctctgccctctgtttatccggcgaactgcatacttaccttgctgacctgaacgaacaggcagcggaaaggtgcagccttatcattgagcagatgaaacaagccgagggcgtgaccgaaaccatgaaagcagacaatcagatgttgtgggtacagtccatgaactctatccgtaaccgagccgaagaaatcatcagacaggaaatgatttactgctgattttatcaagtccaaaaccaacaaatttgtatcgtaaacgaagcgacaggtatttccttatgaagtgtctgtcgcttttcatttatcaaactttaaggaggaaaacacaatgaagatgaaccggaatgaaatggaagccctttatgcctttggctgtccgaacctgaaagcaactgtcgagcgtttgcgtatggtagctgcccttgcacccgatccagtggcgaagaagctgttttatatgctttccgtcaagctgagtgctgagggtgttgaaaggtggtatcgctgcttttactgcaagctgcgtgtgttgaaaaaccatagggagggctgctatgacgagactgacgaagattgagaaagaaacaatcgttctctttaatgagggcgaggacaaggcaaatatctacacccacaacgccggattgaaaaagaggttggctgcttttgctaagaagtaccctgacctttgccgactggaaaaatccaatgttcaaggcggtgtttcttatgagctggcaaagtcccgtctgtctatccgtttcctgccgccttacagtgaggaacgcagacagaaagccagcgaatatgcgaaaaagcatgggctgaacagccagcagggataatgtgataatcagggctgatatgcggttaaaatgtcaggtgcagacctgatgttttgaccgttgcctatcgcctgtgaggaaagtatcggggactatggattttgccaaaatgtgcgttacaaggtttgaacaggaactctgtacacaaaattttttcttccattctttaggctgatgaagtataatagacaaaagataattttagaagtgagcttttcgggaggcagtatatatggaaaaaagtaaggtagaatttgtatataaaaatatttcttcattaaacaagataagtatagtgaataaaaaaatatttcgtattttgccatatatttgtgtgtcatcacttgttgtagggggaattgcggtttttctaaaagaaatgttgcctataaaaggagtgttgcctgattatattagacttgtttgcttagtcatatttttcttaacctttttgatgtggttggtgtctttcttttttgaatacattttcctgtttttatggaaatgccctgtatgtaaaggaaaatttccatggtataagactactttgggatatttaggagaagaaggaggtagtcttgtaaataaagaagttaaagatatttgtgaccgcaagaataagaaaatatctttaattcaatatgaaaatagcaatttaatcattcccaaaaagtgtccgcactgtggggaagttatatggaaaaaataatttttgtagattacctgtaatctgccacaactgaatatgaccgttaaggtcagatgaagaaaccgatgtattgagcgtaaagcgatcatgcgtcggtttttcttatttcatgagcagacagaattccgactgtatatcacccgtgaggaaagtatcggtgactatggattttgcataaatgcgcgttacaaggcttgaacaggaactctgcacacaaattttttcttccattcgttaagttgatgaagtataatgaaaaataagataaagttaattcttggaggtgttattcatgtttggttttaagaaaaatgaaaagccaacgctcattattgaagcaaaagatctaatggaaattatcaagtctgattatgataatgatatggcttttactcttattgagttttcctataatgagaaaaaatatgtgatgggttcctgtgttttacctgctaacgcagaggaatgtaaagaaaatatatcttttatatttcaagacagagtttttgaaagttttgaggaatttcaaactgctattattatagataataaaaacatcttacaattagaaaaaccccttgaaattttaagagcaggaattattgataatgagcctatgctgaaaacgccatggggagataaaagattagctgataaagctgttaataaatagcgtgtcgctttgaaaggagtacaaatttatggcattattgatgtttagaacttttggagtgattatagtatcatttatagtcttaattatgtatgttttgcatagaaagaaaaatgggaagtttataaaacgaaaggctgtcaatgaagaagaaaaaataaaatatcaaaaatgggaaaaaataatcaatgtgatggcagttgttgggttattgattctcggtatatttataactgttccttgttgcttggatataccttatttactatctaacaatttagttgaagttaccggagaagttacacaaggtgcaatgtcaggagaaaactctaatagtgaaagaagaatacatattagagatgagaaaactggagaagaacattcattaaaatattggggaacaggtagcgatttaggagataagataactgtaaggtatttaccacacacagaatatgggtatgtagttgaatagaataaaaataaatatcctattttgttttgggaaatttgtagattacctgtaatctgccacaactgaatatgaccgtcaaggtcagataaagaaaccgatgtattgagcgtaaagcgatcatgcgtcggtttttcttatttcatgagctgacagaattccgactgtatatcgcctgtgaggaaagtatcggagactatggattttgcggaaatgtgcgttataggtaagtaaaaaactacttgatagagcgtgaattgaattgttcatatcggtatgatataatttactgaaatgaagcaagaaggtggacttttgtatgaaaaaatttttgaaaatattgctaatcattgtaggaatagtttttttgatttttgcagcgctgatatgtattggactgtttgttgattatgatgaccatattgaaaatggtcgttatacttatgttccggaagatgacaataaagacaatgcatatgtcgaattcaatttgagtgattacgataaaaaggattctgaactcatatattatagttctgtcgaagaagctattttgaattctcctttgaatgctgaaaatgaagaattttctgttccagaagattttcttaatcatgttgatgaaatattgcatatatggaatggcaaacagtatgatactattttctatcgggtaggaagcgataacgatcccgttcaaggttttgtgatggcacgctgcaaaaaacaggtggaggaagcaagtgtacaatatgcatttatgaatgctacaccggttacaactaaagcggatagcattcttatatctgatattacagaactaattcgttcatctttaaaattaagtgattttcaacaggacttgaatccaaattatccagataccagatttgtttttggctatgcacatgataaggaaatttactcattagaagtagaaggtcaaaagccagatggtgttattgaaatcaatgtatatgacagaacgatgtatctatggtattatgatgatttaaagagcgacaagagaggaaacaatctaagttattcagtagatgtgccagagtaatttttcaaattggctaatctgccacaactgaatatgaccgtcaaggtcagatgaagaaaccgatgtattgagcgtaaagcgatcatgcgtcggtttttctttttgcaaaatagtccggtggactgttttgtaaaaccgaaggaactgacagagcttgggacggggcgaagtcagttcgttcgggcgggagtacagagggtgcaaccctttgtgcatgggtacagggaatgcaatacccctgtgcaggtcaagggcggcagccttgcccagttaagtggcgtctcgccacttagtactgggtattacttgacgcagaaagccgcatggaatcagcttcgctgcccttctcccctgtcggggaaatcaaaaagaaaaggaggaactcatgtgaaattaacaaggcacaatggacgagccggaaagaatggcgtttataatccgaagcacaatgaccgcagttttgacattgccaacagcgaacacattgacgaaaaacgagccaaacaaaatctctattgggactgttacaatggcttccgcaatttcaaaaatcccgaaaaggaaaatgagctgtctgccacttttgaagatgtggaacagcttttttatcgtcagcggtatcgtgattttgtgaccaggcagaacgaaagaaatgtgaagaaccgacaccctgaaagaaataaggaaaccggagatttactcaaaagcaaaaagacctgtccagaggaaacggtctatcagattggaacgcttgataatcatgttccgccggaattgctcattgagatcgtcacagaatttatggaaatcgtaaatgagcgtttcggctctcatgtccatatcctgaattgggcgctgcacttggatgaaagcacccctcatattcacgagcgtcatgtgttcgactgtgaaaatcaatatggggagattgccccacaacaggaaaaggctttggaggcactggggtttgaactgccggaaccggagaagccagtcggaagaaaaaacaaccgcaagatgactttcgattcagcttgccgagtgctgctgtttgatgtggcgaaaaagcatggcttgcaactggaagaagaaccggaatatggtggtcgtgcttatctggaaaaacaggactatattcttttcaagcaaaaggagcaactggcagcacaggagcaaaaattggaagaactcacgatgaagattgaggatgtggaagctctggtggatgaggttgccgatattgcctatgacaaggcggttgaggtcgttgctgatactgtgaaactggaaacgcacaaggaggatattaagctggtggagcagtctaaggcatgggttctctcccctgagcgtaaggcttcaaagaaagaagttgagtatgcagtgaaacgattggatggagtgattgccagaatcacaaacgctatgaaatcaaccattcagaaaattcaaaccacgctgatgaagccggaggtcaaaaaagccggaacggagcaaatcaagaagaaagccaaaagttccattatagagcagttgagccgcaaaaagaaagaaattgcagagcgtgaagtcagccgaacaattccggcgaaaaacaaaaagcaggatatggaactctaaggcacttgctgttttcattttgaaaatgacaggtgcttttgctttaggaagcaagaaaatatcttccattctttaggttgatgaagtataatgatagtaagaaattttttgtaatgaccttaatccaataagtgattttgcaattatcaagtaaaggatgtaattatatgaagaaagtactgttgcttttcagtgtgattattatactcggtttaacaggctgctctaacaaatatttcaatgactggtttagctctgaacaaaatgaaacggataagatgtgtcaacaaattatcgaggcatgtaagcaacaggattcagagaaactcaaatctctattttccgaagaaagcaaaaagaacattgagaatttagacactgaaatctctgcttttttcgattatattgagggcagtatccaaagttttgagggcgattgtgcatcatcaagtgaaagcaactatggtaaaaggaaaacggaattggatggtatgtatctcatattgacagagaaggaacggtattgtatgaatttttatatgtatagtgaggatgatgaaaatgcccaaaatgtggggatatataaaattgaaattgcattagagagcgaagtggctgaggataattttatatgggataatcccccaaacggtatttttgttggaggacaaaattgatttttgttatgagagaacattaaagtataaatttcggatggtataagaaaaactgactacaattaaatcttcacagctttactaagcaggaaatctgaaaaggtctcctgcttttttgcacccaaaattgaatatggaactttaagacacttgctattttcgttttgaaaatgacaggtgctttttttgtttcaggaaaggagtcacatgaatgtatttgaagttgtaaaagaaaatgttactgcccgacaagccgcagaagcctatggcttgaaagtgggtcgcacaggtatggcgtgctgtccgtttcactcggataagtcccccagtatgaagctggatgaacgctattactgttttggctgcggagtgaccggagacgctgttgatctcacagcgaagctattcggtatcgggctgagggaagctgctgtcaaacttgctgaagattttggtcttaactatgacagccgacaaaagccgagtattcgccctcgtattcgtgatccgacaccggagcagaaatatcaaaaagaagaaaatcattgctacaaggtgctgacagattattttcatcttcttagagaatgggaaaagaaatacgctcctaaacagccggatgaggaatggaatcccctgtttgcagaagcactgcataagaagaactatatcgaatatctgcttgatattcttctgtatggttcattggaggaacgaaaagcacttgtggcagaacagagaaaggaggtgttgaaacttgaacaacgaattgcagaactgtcagcagacagaaccatgtacagtagaagaaatccgaaacagcttagagcagagcgagaaaggtaaggtttataatactgccgcaaattataagcgtgttctgcaatatgacccacttttgaaaggggctatccgaaaaaatcttctgaccgaaagaatcgacattgtgaagtccctcggctggtatcgtgacagcccgacattgacggatgtggatgtgaaatatctgctcctatattttgaagaaaactatggattgaccgtagagaaaaaaatcatagacgcagttgcggttattgccaacgaaaaccgttaccaccctgtctgtgattttcttaatgccctgcaatgggacggaacggaacgcatacgcttctgtctgcaccgctttctcggttctgatacagatgattacacctatgaagcattgaagttgtttctgttgggtgctatctcacgagcttttaagccggggtgcaaatttgaggttatgctctgtcttgtgggcggtcagggagccggaaagtcctctttcttccgtttgcttgcggtcaatgatgactggttctctgatgacttgaaaaagctggatgatgaaaatgtgtatcgcaaaatgcaggggcattggattattgaaatgtcggaaatgattgcaaccgctaacgctaagagcattgaagaaatcaagtcctttctgagccgccaaaaggaaacctataagataccgtatgaaacacatccggcagacagaaaacgacaatgtgtgtttggaggttcttctaatactcttgactttcttccccttgaccgaacaggcaaccgccgcttcgttccggttatggtctatcctgaaagggctgaggttcatattttggcagatgaacaggcttcaagagcgtatatcaatcagatgtgggcagaagctatggagatttacagaagcggcaatttccgtctgagattcagtccggctatgaacgcttatctgaaagcccaccaaaaggattttatgccggaggacacaaaggcaggacagattttagactatttggaacgctattccggcagcatagtctgctctaagcagctttacaaggaagcactggggcatgattatgacgaaccgaaacaatgggagctgcgagagatcaacgacattatgaataacgctgtcacaggctggagggcgttcagcaatccgagatattttccagagccttaccgccgacaaaaaggctgggagcgtatcaggaatgacaacgagcctgacaacagcatggatggttttcaagaaatcccggcagaggaaatggaacagttaggacttccggaagaatggttgaagcaaaaataaaagcccgttgtcgcttcggttgtcggtctggttgtcgggcgaaaatcccgaaagccttgatattgcggcacttttccctctctgacaaccatgacaaccaatattataaagaaaaaggaaatagtaaaaagatagtatcgcccgataaagaaaaaaggttttctgatgtccgttgtcggaacttcgttgtcagacctttccttgtcgggcttttttcatttaattaggaggaatatcgtatgacaaatattgtgaacagtacactacctacccaaaataaccattcggagaaaaacaaaccggatggagtttttgtgattaagcaaggcaaaacaaattataaagtcaaagtgttttttgaccatagtagcggtttgactgctgaggacagattgaaacgcattattcaggcagaagcagagagagaatctgcgtaagtaatatgaaaaatatccacgcacccccttgacaaaagctttcagaagattctctgctctctgcaatggaactggccggagcagaggatatgggggatgatgtggagcgtaaaggtcttggcacacctgcaaccagagcagacattattgagaaattggtcaaagacggtttcgtgaagcgtgagaaaaagcagatgataccaacagaggacggcatgaagctgattacggtgcttcctgatgtggtaaagtccccgaaacttacagccgattgggaaaatgcccttacccttgtgtcaaagggcgaatattccatgcaggaatttatggatggtatcgagaacatggtgcgtgatctggtgcagacttaccacagcatcagcgaggaacagaagtccatgtttggagccggcacacaggaagcacttggcaaatgcccgaaatgtggtagcgaagtggtaaagggaaaattcggagcttactgtaagaataaatgcggcatgaatgttggcagggcaatgggagccgtactttccgacagtcagataaaaagtatgttggagggaaaaaagactcttgtaaaaggactgaaagggaagaaaggcagctatgatgcgtatcttatcccggaggggattgaagattattcctatatgaaagacgggaaggaaatcaaaggctcacagtataaggtcaagatggagtttccacagaggaagaaataaaatctggtagagggatagatgtgaaagtggtataatttctttgcataggtgctatgcacctatgcgtgaaaataagaatttgaagggaggagtatatatgtttaattttgatggatatacgaagttagtggtattcaaaaacatagaaaatcaacctatacaggaagttcatggacagaatatccctaaaagtgagagaaagtgtatcttttgtggtaatgaaaacgcaaaatttactaaggttgcacatgcagtttcagaaactattggaaataaatcacttatttcacattttgagtgcgatgaatgcaatcagaattttggtaaaatgtttgaagatgatttgggtaaatatatgcttccttataaattgttaacaaagacattcggaaaaaataatcaattatcttccaaagacatgccaaaagaagacggtatttcatatggaacttatcgcattcaattaaatagaaataaaccagttcttgaaaatattgacgtaaaagcgttaattattgaggcaaaaaatactggaattattaaattggataatgataaaattgaggtaaatattcctcgccagcattactttccaccgtcaatttattgttcttttttaaaaatggcatacagtataatgcctctaaatttatatcctcaatatgtaaaacatattgttgtattgcaacaactagtatcagcaagaagtatgtatcaaagtgtcgaactgaaaaaagagattatgcgttcaatggaaaattgcggactgttttgcttttttccagggcagaatccacttaaaggggtaaatgttacattgtggaaaagtttggattcaaaagagcaagaatatcctcgtgtgttatttacactagaaatgaaaaatttttcttttacaattccagtgtgtgcagatgatgaacagggaatttgtaaaatgcctagatttttaagtgatatggaaatgcaatatggaccattggatttgcaaaatgaagaaaagatatttaattgtgaaatgagtggagaaacaatagatattattgattataaattattagaggatgaattgagaaaaaacaatttgttgaaataacttaaatcagtcaaatcccagtttgtagcgctggaaggtatgaaagtgtaagggatataatatgtttttgattatagttgacttgatgatggcaacgagaggacggtgatgattgacatgaggctttgcattgcattgaccggtatagtttataaatcataataaaacatttggaaatatttggaggataaaatgactatatcggataaaaacatgaattataaaataatagataagcagacttattacaggagtggagtgttccggcatttttcggaagattgtaaatgttccacttctatgacggcaagaattaatgtgacagcactgaaaaagttttcggaagattctggtacgaagttttatattaattttctgtatgtactcgcaaaggtacttaattccagagaggattacagaatggggtatatttggcagaccgaagaactgatttgctatgaccagattaatcccgcacagtatatttttcacgaggatacggagacctgtacaccggtttataccgtttataatgtagactatcacgttttctataaggattgtgcagaggatatcagaaaagcgaaggagacaagagaatatcttcttgatatggcaaatcatccaaactggtttgatgcttcttacatttcatggttgtcttatgactcattgaatattgagcttccagacgggcatctattttttgcaccgattatcaactggggaaggtatcatgaagaaaacggacagtttttaatgccggtcagtgtgagactgaatcatgcaattgctgacgggtatctggttgcaaaggtatttaagctgctggaggatgagatgtcagcattttgtaatcagtataagaattaaaggtctaacttaccttaaaagagaaaaatcggaagtatagagaggaaatatggcatcgagtaaagattatttagaatttattttaggacagttatgcgagttaaacgatatatcatatagagcaatgatgggagaatttatactctattataagggcaagattgttggtggaatttatgatgacaggctactggtgaaaccagtaaaagcagcaatttcttatatgccaaatgctgagtatgaattgccgtacgatggggcaaaagagatgttgcttgtagatgatgttgacaataaggattacttgaccggattgtttgatgccatgtatgacgaattgccaaatccaaagcccaaaaagaagaggtagaacaacaatcccagcttgtcgagctgaaaaatttgaattcgtaggaggtatcgaaaaatgaataggaaaactttattctgttttctgacagctttgataatgatttttgttcttgcaggctgtggtggaaagaatagtggtgggaatattgacaatgttcaaattcctgattggaaaccatcggaaatatattcagacagtgatattgaggcggctttccaaacagtaaaagactatttcggcaacgaatttgacggctgcacactgacaaaactgtcctatcccggagatacatacgccgatgaattttatgaatgggctgaacaatatgacgcggatgaagcaatcgtaatattatcatctttcgatgtagactcatcaggcggggatggttcgcttaatccggattcaacatatgatgattggaaatggattctaattaggaatgacagtgggaattgggaacatgttgaccacgggtattaaagcgacagattccagttttatgttttttcataaaatccaattattactttcacatcactgataatttaatatcagacagcgttagagcatatagaaccaaaatctatatgctctatttttttacgcaaataaaaaacaggaggaaatctacatgaatgaagcagtagaaaacgtaacagaaaacacagaagtaaccagtaagcaggaggaaacgaaagcggagaaatttatccgtcttggagagtatcgcatgaataaggcgatggatgcgattggcagactggagcatcttgccaacaaatcagcttatgaatacacaccggagcaggtggaagccatgttctctacgctggagttacgggtggcagatgtaaaagcaaaatttacggtaacgaaaacaagggaaaatgcaactttttcctttgggacaaaggcagagtaggacgcataaggcggtgggtttctcaccgtcattttaggaggaaagtcgatgataacaaaataccagatgatctccataatggcggaggaaaccgccagagagattgcaaaaaatgaacaggcatggacaagatatctgaccacggctgcaaggttatacaaatatccttttaatgagcagatgttaatctatgctcaaagaccggatgcgtctgcctgtgcttctcttgaaacatggaatgagaaaatgaattgctgggtcaaccgtggagcaaagggtatcgcactcattgatacggagagtgaacgtcccagattaaaatatgtatttgatgtatcagatgttcataaagcaagaagaattgggcgtgacccttatctgtgggagtttcaggaggaacataaaaatgctgttatggaacagcttgaaaaaacttatggggaaacggacagcacactgccatttgaaagcaggataatagaactgtctgccaggattgccggagattattatgaggagcttcttccggaaatttcctatgtaaaagaagggagctttcttgaagatttagacgaatttaatgttggaatcaggcttcgggagatgttatccgcaagtatcgcatacacgcttttatcccgctgtggtgcggatatggagatatggaaggatgaacttgatttcagctatatcagtgatttcagcacaatggatacactttctgttctcggaaccgccactacggaaatgtgtaaaccagtgctgatggaaattggaagaaccattgcagcccatgatcgacaaagtgcccgaaataaggcaaaaaacaaggtaaatggggaacagtatgaaagccttgagaaaaacgcccaaaaagagcttgcaaatgagtctgaaccacgctataatgcgttaaagcgtgaaagcgagaacgaagcaaataaaatggaaacggaggaaacagcatatgaaactgacatacgagaagaacggggattatctgataccgaacctgataccaaacgaggagccgcaggggacacttacaaagtacggtctgatgaggaagaactttctgaaggaacacaggaaaggaatttattagggaatgatgctgaaaggaactctgaaagagcattgtctggagacacaggagcaggcagagcagaggatggaaatgctgaccggacagatggcgcagaaagagggagtgaacgaggaattgaaagcagccgatcagatgagctgggtagcgaagatgaacaacatcagacagtcagcggaggaaatcgtgctgaaggaactgatttacatttagacagcagaatagaacagaatgaggaacaactggagccggatagtggaagtaattcattatccggttcttttttggataatgcacaagaggaagattttactaacctaaaaaaaggtatcttgtgctttaataaacacctcattcataaaagaccggagatagcaggctatttccagatggagcaggatgcaagactccagacggactatctgaaaaattccttccgcatggaggagtttacagagctgtatataggagaaaccagggcagggtatcgtgccgatgaagatggacttaccatgtggaaagggaattatctcactcgtgaagaggaaacaagaatctcatgggaagatgccagatttcttgttaattcttatatagaggacggggtgtatcttcttccgggagaagtggcagagcagattgatacggatggaatgtataaacaacttgaccttttttccatgttttcggagcaggtaggaaatattgccatgaaacaggcagaggaaacaagtatagtgccaccttctactcaaataccgcaagagcagattgacacaatcctcagaagtggcggaggaaaggaaaacagcagaaaacgtatctatgccaagtatcagcagggaaagacgccggaagaaatggcggtttttcttcaaaaggaatacgctactaccggaaaaggttttgaatttgacggaaaacaggtatcggtatggtttgatgagcagggaatgagcatcggacatgggccatctgcgttggaatatcctgtggctaccatgagctggcaggaagtagaaaaggaaatacgttcacaggtggaaactggcacttacatgggagcaaatgaagcctatctcgtggatgaaagcgaacgtgatcgtcttgcaaatcatatttttttctttttccgtgatggtattggagaaatgccggaggagctggggctgaaacttagtaattatccggatgctcattccagactggtggaattattatccacgccggaaggagtggaacttgttgcatctgatatggataaagcattacagcagattgaaagcggagagaaggaatttcgttttcgttccataatatcaaaggaggagcttagagcagaacttgataatctgcttttggaaaagctaacctttcctactgctgataatgtggagattaagaaagaggattttatcacacaggatgagatagaccacaggcttggaaggggaagcgggtttgcacatggctctttccgaatctatgattattttaaggaggggcatgacagcaaggaggcagttgctttccttaaaaacgaatatggaacaggaggcagttctccggcactggctggaactgacagaagtaatgaaaatcatgatgcaaagggtatcaagttggagaaaggcagtatcatggagccttacacagaggtacttttatcatggaatgttgtagaaaggcgtatccggaaactgattgaggaggataggtatttatctccagaagggaaagaagcctatgctgtgtataaagaagatgaagccagaaaggctatgcagaaagcgcaggagaaaatggaacgtgacacaaaagtttcctgcaaagaagcaatagaaaaagcgattgcggagaagtttgacggataccgactgccaaaggaaactgcggaagatgttattcgtgaatatggaagcgaaagagttgcgtatgtgcttgccaatacggttatgcatcttagtcatgatggcagattttcgctggataacaaggaatgggcagaggaaatcgagccttatgccatgattgaaaatagggatttgattgtaagttcccaccctgccgtattaaacggatttatcaaccagacaagaagatatattgagcatgagaaggagcttgcagcacaggcggcagtggaaaatactattaccattgacggacagaactgcatacaggttgatgaatggaagtccggagaggacacttatcagcttggtaattccacagaggatagtgagttttattatgcagagataaatggaaatacccatatagaatatgatcataagccggaccgggcagagattgaggaagattatctgaacatcatggcagagagggatattgaccaccatgaagcagaagtttttgcacgatttgagggcagtgatgatagttcggaacaacttttggcggcagaagttgtgaaggacacttctggacaggatgtccaaaagtcagaaccacagattgacagatcaaatgcagtcaacttccgtattatggatgatgctcttggaattggcggggcaaaggaaaaatttagaaggaatgtggaagcaatccgtacgctggagcagatagaaagtgaaagccgtcttgcaacgccggaggaacaaaagattttatcacagtatgtcggttggggcggtttggcagatgcctttgatgaaagcaaaagtgcctgggcggtagaataccaggaattaaaagaactgttatcggatgcggagtatgcttccgcaagggagagtaccttaaatgcccactatacaagccctgtgattatccgtagtatttatgaagcgctggagaacatgggctttgaaaaaggaaatgttttagagccggcaatgggtatcggaaatttctttggtatgctgccggagaagatgcaggaaagccggctttatggagtggagcttgatgggattaccggaaggatagcaaagcagctttatccgaaagcggatattaaaatcacaggttttgaaaaaacagattatcccaatgacttttttgatgtggcagtgggtaacgtgccgttcggacagtataaggtggcagataagcagtatgataagaataacttcctgatccatgattatttttttgcaaagacgttggataaagtccgtcccggtggtgtggttgcctttgttacttctaaaggaactatggataagaaaagcccggaggtcagaaagtatcttgcacagagggcagagcttctcggtgcagtcaggcttcctaatacggcatttaaggaaaatgcaggaacagaagtcactgccgatattttatttttaaagaaacgtgaccgtgtgatggacttggagccggaatgggtgcatttgtcagaagatgcgaacgacattgccatgaacagttattttgtccaacatcctgagatgattgcaggaaaaatggaaatggtcagcgggccatatggtatggaaagtacctgtatgcccgataccacaagaccatttgcggagcagttaaaggaagcggtaagccgtatagatggggagatagaagccgtagaaatggatgaactggcagacgagcttgccgatgccactattccggcagacccggatgtaaagaattacagctatacgcttgtggacaataaggtatattaccgggaaaactccattatgaagcctgtggatatgccggaaaccatgcaggagcgtattaaggggatggtggatatccgtaaatgtacacaggaacttatcaatttgcagttggaagaatatcccgatagcgcaatcaaggaaaaacaggcagaactcaatacgctgtatgatgctttttccaagaaattcggtttaattaattcacagaccaacaagagagctttcaatcaggacagcagttattgcctgctgtgttctctggaaaagctggatgatgagggcaatttcaagggcaaggcagatatgttcacgaagcgaaccattaagaaagcggaagttgttacaagtgtggatacagcaagtgaagcactggcggtgtctttatcggaaaaggcaggaatagaccttgactatatggcaggtctgcttatggacaaagctgactatatggacagtgaaaaatatgataagatgcttggaaaaatcaaggaggagttaacaggcattatctttcaaaatcctgtgacggacagatgggaaactgcggatgagtatttaagcggaaatgtccgtgataagctggaaactgcaaaggtttatgccgagaaccacccggaatatgccgtaaacgtgcaggcacttacacaggtgcagccgaaagaactggatgcttccgagatcgaggtgcgtattggtgccacatggattgaaccgaaatatatcgaggatttcatgagggatacttttgaaacaccacatcatctgtttgaccggaacattgtgggtattcaatattccgatgtcaccggacaatggaacgtaaagggaaaaaatgcggattatggaaatgcccttgtaaacgtaacctatggaaccagccggagaaatgcgtaccagattttggaggattcccttaatctgaaggacagccgtgtgtatgacaccatagaggaggatggcaaggaaaagagagtcctgaataagaaggaaactaccatagcgagccagaaacaggaagccataagggaagcatttaaagactgggtatttcgagatccggaacgcaggcaggtacttgtggaaaaatataaccgtcttttcaattccaccagaccgagggaatatgatggttcacatctgaaattccccggtatgacaccggatattgagctgaagccccaccagaaaaatgcggtggcacatgtgctttacggggataatacactgcttgcccattgcgtgggagcaggaaagacttttgaaatgacagcagcggctatggagagtaagcggcttggattatgccagaaatcattatttgtcgtaccgaaccaccttacggagcagtgggcaagtgactttttacgattgtatcccggagcgaatatacttgcagctacaaagaaagattttgagcctgccaaccggaagaaattctgttccagaattgccaccggggattatgatgcggttattatcggtcattcgcagtttgagaaaatcccgctttcacaggaaagacagattgccattatagaacgccagattgatgagattgaacttgccattgagcaggcaaaagccgacaatggggaacgatataccattaagcagatggaaaaatcacggaagtctttgcagacaaggcttgagaaactgaacgatacatcaaggaaggacaacatggtaacttttgagcagcttggtgtggacaggctctttgtggacgagtcacataattataaaaatctgttcctttatacgaaaatgaggaatgtggcgggtatcgcacagtcggaagcacagaagtcctcggatatgtttgcaaagtgccagtaccttgacgagctgacaggtggaaaaggcgttacctttgcaacaggtactccgatttccaacagtatgacagagctttataccaatatgcgataccttcagtatggtacgctgcagaagctgggacttggtcattttgacagttggtcatcatcctttggcgaaacacagaccgccatagagcttgcaccggagggctatactttaataggacgataaaattaactgtcctaaattgaaaatacataaggaaggaggttaagagaatgtcaaggacttcaaagattacagcactttatgagagattatcaagagatgatgacctgaatggcgagagtaattccattaccaatcagaaaaaatacctcgaagattatgcccgtagaaatggctttgagaacatccgccattttactgacgatggtttttcgggtgtaaatttcaatcgcccaggctttcagtctttgataaaagaagttgaagcaggcaatgtcggaacattgattgttaaggatatgagccgattagggcgaaactatctgcaagtcggattttatacggaaattctgtttccgcagaaagatgtccgttttcttgcaatcaacaacagcattgacagcaacaatgcttcggataatgattttgctccgtttttgaatattatgaacgaattttatgccaaagacacgagcaataaaatcaaggctgtatttgatgcccgaatgaaagacggaaagcgttgtagcggttcaatcccatatggatataaccgattgccgagcgataagcagacgcttgttgttgaccctgtggcttctgaggtggtaaagcgtatctttctgcttgccaatgagggcaaaagtccacgagccatagcggaaatactgaccgaagaaaaggttttaattcctgccgcatatgcaaaggaatatcacccagaacagtacaacgggattaagtttgcagacccttatatttggggcatatctgccattagaacgattttaagcaggcaggaatatcttggacatactgttttgagaaagtcggtcagcaccaattttaaattgcataagagaaagactaccgatgaagatgagcagtatgtgttttataacacccacgagcctatcatatcgcaggaactttgggacagcgttcagaagcgaaagaaacgagtgaacagagctgcggcaagaggtacacataccaaccgattaagcggttatctgtactgtgccgactgtggcaggagaatgactttgcaaacgcattatagcaagaaagacggttctgttcagtattcttaccgttgcggcgggtatgcaagcagggttaattcctgtacttcccatacgattagtgctgataatgttgaagccttgatattatcggcagttaaacgcttttcaagatttgttctgaatgatgaaaaagcctttgctttggaactgcaatccctttggaaagataagcaagaggaaaagccgaagcacaatcaatcggagttgcaccgttttcagaagcgatacgatgaattgtctaaacttattcgtggcttgtatgaaaatcttgtttcgggattactgcccgaaagacagtataagcaactgatgaagcagtacgatgacgaacaggctgagctggaaacgaagattgaggaaatggaaaaggaacttaccgaagaaaaagtaaatgctgttgatattaagcatttcatttctttaattcgcaagtgcaaagagccgacagaaatttccgatttgatgtttgctgaactcattgacaagattgtggtttatgaagcagagggtgtgggaaaagcaaggacacaaaaggttgatatttacttcaactatgtcgggcaggtcgatattgcctatacagaagaagaacttgctgaaataaaggcacaggaagaacagattgagatggaacgcttggcaaaacagcgtgagcgtgaaaaagcctaccgagagaagcgaaaggcgaaaaaactcgctgaaaacggtggagaaatcgtcaagacaaagatatgtcctcactgtcaaaaagagtttgtgcctacaagtaaccgacagatattctgttcaaaagattgttgctatcaggcaaggcaggacaagacaaaagccgacagagaagctgaaaaaggaaatcattattatcgtcagcgtgtctgtgctgtgtgtggcagtacctactggcctacacacagtcagcagaaattctgttccgaagaatgtcaaaagataaaccataacgagaagtctttggaattttatcacaagaagcagaaggagaaatcagaatgcaaagatttattacagacgaaagaactggtatccagtacgaactcatcggagattattactatccctgcttgacgatagaaaacgaagaaccgcctacgctcacaaaatacggaagaatgagggaaagatatttgagggagcataggaaagtcttatattgcaatctgcttacaagcggaaagttatatgaacaccttgctgaaattgatacttcggcgtgtaatatggcggagtatctgataaaggaaatggcaagaaaacaaggtgtgacggaacaactgaaagcggaggatatgatgagatgggtcggattgatgaataatatccgagcctgtgcagatgagattgtattgaacgatattgtgtattcctaatagcataccagccgaaaaggaactgctgtctttactgatggcagttttctttttcgggaagtattcaagaagtcattaagtcgtgagtgtaatggaagtggttaaattgaaagttcataaagatggtatgatgtgttaaaatgagagtgatgaattgtaattttccgcattgaatattaagagacttgtaggtgtaagccttttgctgttttattatattctttcaaaaaatgaaagctaatctttgaataaatattttttgaatttaagtgacgcttgacacatttttcccgtttattagggtgaaaggccttaatacaagggaaaggaggagaagcctatggatgataagcagatattagatttatattgggagcgctccgaagctgctatatccgaaacttcaaaaaaatacggaaagtattgcagatacatagcctttaatattcttcacaatgacgaagatagcgaggaatgtgtaaatgatacttatttaagagcttggaacagcataccgcctaaccgtccatctgtcctaaaaacttttttagggaagattactcgcaacctatctttggacaggtacgaactgcttaatgcaaagaaacgtaatggtgggcaaatgccattggtttttgatgaaatacaagagtgcataccatcgttggatagtacagaaaacattgttgaagaaatcgctctaacggatattctcaaccgctttctttcttccctgtcattagaacagcgaaaaatctttatgagaagatattggtatttatcgcccattaaagaaattgcaacggaatatggtatgagcgagagcaaaatcaagatgtcattatttcgttcaaggaacgaactcaaaaaattgttagagaaagaaggtatctctgtatgaaagaaaagaaacttttaagggcattgggaaatgtcgataatcagtatattaaggaggctgaacctatgaaaaaaacaagtaaaataactaatcggcaaaaatgggtgtctgttgcagcttgcttcgtactcgttgctgtgattggagtgggagtttttcaaagcaatctgtttggtacaaaaaacgatattgccacgctgaatgatggagaaacaattacttttgttaaaaatgacttatcacaatcttcaattaacttaaatgtaacaacaagacctttgagcgatgctgaaattgaaatgctttttgcagacttgcctgttaccgcagatgcttattttgatgctgacaatcataatattctgggttttgagggaaaaattgatgatacaagaatggtagtttctaaacagggtgtaaatctattagatactatcattgatggaaatacaatcacttcaagtgtagacggcgttgatatcaacgcaggatatttcgtaacaaagtcaaatagtcaaggtgtcaaaaccgtaatatattatgcaacctttgatatgggagagaacactatttatgtagagtattctggcgttgaaaatgaaagtgaaactgtaaaaaacaacttggcagacacaattttgaagttgattgagaacggtgcatttgatttgagccaaatccaagaataatctgcaaatttcatatactaagaacttgatgtaacaccctatacccttaaaaaatagggaaagtaatataaagccccaaaaaacaagtctaaaaagttctattagaacggtatcttcgctttttgcctgttcttatgattataattttagtggtcacgttttttgctacttgaatgacagaaaacatcgtagaaatacggtgttttttgttgccccaaaccctacaatttcatacataaccacaggttagtacaaataccttgcgtgatttttttgaaaggcttagaaaggcaattttgcccgattttcgccccgaaaaatgacagaaacaaggctctgagtatctttcctgtggtttttttatttccagacggaaaggaggactttatgccgagaatgagcaagaaacggaaacaagattgggcattgtttctgaacgaaagaaatcgcattacctacaacgaactttgcagaaaatgcagtaatgactgcaagcagagtttccgttgtatcgtggtgctttgccctaagtatttatcgaaaaggagaacgaagaaaaatgaagcaaatggaaaatgaaatgaatgtaaatgtccctctcgaagttattaaggcaagtgagattgagccgaaggaagtgaaatggctgtggtatccgtatattccgtacggcaaggttacgctgttgcagggcgatccgggcgatggaaaaagcaagttaatgctgtcaatcgccgcactgctctctaagggcgaacctctgccttttactgaaacggaagaaaatgagcctatgactatcatctatcagacaacggaagatgatgcagacgatacggtagtaccccgatttaactctgccggtgggaacggagaaaaccttatcttcatcaaggaagatgaaaagtctttatcctttggagataaccgtattgctgaagcaatcgaaaagtatcacgcaaaacttttaattcttgacccgatgagttcctatatcggagagaactgttcaatgaacaatgccaacgaaacacgagcagagtttaatcacttgatatcagtcgcaaagaatactggctgtgccattgtgattatcgctcatatgaacaagatgagagataccaaccctctttatcgtaccaacggttctattgatattgcgggtgctgcaagaagtattcttgcgatcactcgcacaccgaacaaagaagcaccagcagaaagatatatggtgcaagtgaaatctaaccttgccccgacaggctcggcaattctttttgaggttgccgagaaaggcgtggactttatttctgaaatggaaatgacagcagaagaagcgttccagtcccttgcccctaaaatgggcagaccgaacgacaaggaaatcaaggcgaaagaatttcttttagaaatgctgaaagacggagaaatgctttcttcggattgcgaagaaagacttgaagccgcagggttcaagaaatcgaccatcaaaaaggcaaagaagaaagcaggagttatctccaaaaagaaaggctttctgtggtactggtctttgccgatgggcgatataccgagagaatgaaagcaggctgtctgatggtgggacagtctgtttttatgattgaggtatcaaaaggaggtcaagggggaacacccttgcccacgacatctttgcagacgaagtctgaaagtgtcatagtgggttacacacattcaaagaatgttgtgtaatggcttcgccctgccgagaaaggagaacgaaaatggcaaaaaacaacaaggcggatatgagttgtgcaagggtaaaacagtatgccgcttctgatgtgagcaaggcggaaaggcacaacgaacgcaagaatgaaacctatgaaaatatgaatgtgattgcggaacgaataccttttaatgtgcatttcaaaaagccgactgccccgacctatatggaacagttaaagcagatggaaacagacggtcaggtgtcgcttcgtgggttgaggaaagacgcaacgctgtttgatgagattgtgattgatgtgaacacgatgtacttcgagcgtaatggtggttatgaatacgcaaaacagttttatgaagaagcctaccatttcattgaagaaaaattcggtgctgacaatgttatatcggcagtaatgcacgctgatgaaatcaatgtggcagcaagcgaggaacttggaaaagagatttaccattatcatcttcacgctatggttctgcctgtggtggagaaagaaatcctatggagcaagcgttgtaaagacgaaaagttgcgaggaacagttaaggaagtagtcaatcagataagccattcaaagaaatggaaatcggatattccaatgaccgatgaaaaaggaaatccgttgttaaggaagaatggtaagccgatgtttcgtgcttcgtacagcatactgcaagatgagctgtttaactatatgacggaacaagggttcaaaggctttcagcgtggcgaatacggaagtacagccgagcatttgacttccctgcaatatcaaatccaacaggacaaagagcgattggagaagttgcagaagcgtattcaaaaggaacaggttaagtatgagcctgcccgtcatatctccaaaaccttaaacgagattgacagtatgggacagaaaacaatcacaggcaaaatggcaatctccaaagaagattattcccaactgactgcccttgccaaagagggtattaccagtcgtggggaaattaagaacttggagcagagtgcaagttattaccgacagaaatatatggacagtgcaaacgcactggaaagaatgaaaaccaaatacaacgaactgaaagaaaagtgcagaccttttcttgaagcgttggagcatttccccgaagttgccaaactttttaccgagaaagtgaagcaacttttttcttttaaggaagcacaggaacgagccgaaaaagaagcaagggaaaaagaaagacaggagcgtatcaaggcacgaaagagcaagcgaggtatggaaagataaccttttccattatactcacgacttaatgacttcttgatatgttccgatgaaacaggctgtatttgtggggtgttccaaacggaatgccccacaatcaatttatgaaaaggagaaaatgattatatgaaagagaatactttatcttatacaacacgaataggcaaaacaacttttattgtaaatgtgaagcaatcggaaagtgcgaagaagcctttgaatacggtgtttcaagagctatgcagacacgagatgttaggagatttttcagcggataaatatttgaatttagaaaacttacaaaaatcatcttgacaaactcgttcccgagggaaccggataccgggcaaagacgaggtttgcgaaattcttcaacctgccggagctgatttcgctttttaaggagagtgcagatattcagacgccggatatgttaaaattgcctgtgccggaggcagagtatgaaaacgtggtgctaaagccgagtgaataccagcaggatatggtggcgtcgcttgcggaacgtgcggaggcagtgcgtgacaggagagtggacgcagcggttgacaacatgctcaagattaccaacgatgggagaaagttagcgttagaccagcggcttatcaatgatatgcttccggataacgaaaattcaaaagcgaccacatgtgtcgaaaaagcatttgaaatatgggagcagacaaaggagcagaagtccacgcagcttattttctgcgatttgtcaacgccgaagggagatggcacttttaatgtatatgaggatatcaaaaagaaactgatggaaaagggcgtgccggagaatgaaattgcctttatccatgatgcaaatacggagcttaggaaagcggagctgttcggaaaagtaagaagcggacaggttcgctttttacttggttccacgcagaaaatgggagccggaaccaacgtgcaggacagactcatcgcattacatcatctggatgtaccgtggcgtccttctgatgtaggacggattttgcggacattcaaaataaaaaagaatgtggaggtaacagacaatggcaaaatcattatttgaggaactgggcggcaaatacgaaaggcaaggggattatttgataccgtgcttaactgtacccgccgaagaagaacaggcaataggcatctgggggcaacggcatttagattatctaaaacagtaccgtaaagttacatacaccaatcttcttacaagcggcaggctaaacgcctaccttgccgacatcaacagacaggcacaggaacgctttgaaaggctcatagagggtatgaaacaggcacagggcataacggaacagctaaaggcagaaaacgccttagaatggacaggatgcctcaataacataagggcttgtgcgagggagattgtggaaaaggaaattatttttgcataaacagatgattagtggcagggggaaatcctgccgctttttctgctttagtttgtcagcttgacaaataaagggttaaggaatataattagattcagtattatacaaggagttaataaatatgcggcaaggtattcttaaataaactgtcaatttgatagtgggaacaaaaagtagcagtctcgtttcacttttaatatggggcttagttttttgtacccagtttaagaatacttttatcatgtaattttatatgcccgaaaacatataagtgttttggggctattggagttatttacccagtgataggagtatttatcactgggtatttttatgcccttttttgggtgttgataggaggaaaatcacatgaaaataattaacttaggcattctggctcacgttgacgcaggaaagacaacattaacggaaagtttattgtataccagtggtgcaattgcagaactagggagcgtagatgaaggcacaacaaggacagatacaatgaatttggagcgtcaaaggggaatcactatccagacagcagtgacatcttttcagtgggaggatgtaaaagtcaacattatagatacgccaggccatatggattttttggcggaagtataccgttctttatccgtattagacggagcagtattattagtttctgcaaaggatggcatacaggcacagacccgtatactgtttcatgcactacagacaatgaagattccgacaatttttttcatcaataaaattgaccaagaggggattgatttgccaatggtatatcgagaaatgaaagcaaagctttcttcggaaattatagtgaagcaaaaggttgggcagcatccccatataaatgtaacggacaatgacgatatggaacagtgggatgcggtaattatgggaaacgatgaactattagagaaatatatgtcagggaaaccgtttaaaatgtcagaactggaacaggaagaaaacaggagattccaaaacggaacgttatttcccgtttatcacggaagcgctaaaaacaatctggggattcggcagcttatagaagtgattgccagtaaattttattcatcaacgcctgaaggtcaatctgaactatgcgggcaggtttttaagattgaatattcagagaaaaggcggcgttttgtttatgtgcgtatatatagcggaacattgcatttgagggatgttattagaatatctgaaaaagagaaaataaaaatcacagagatgtgtgttccgacaaacggtgaattatattcatccgatacagcctgctctggtgatattgtaattttaccaaatgatgttttgcagctaaacagtattttggggaacggaatactgttgccgcagagaaaatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaaagtgcagatggaagtcatttgtgccatccttgaggaaaaatatcatgtggaggcagaaataaaagagcctactgttatatatatggaaagaccgcttagaaaagcagaatataccatccacatagaagtcccgccaaatcctttctgggcttctgtcgggttgtccatagagccgctccctattggaagcggagtgcagtatgaaagcagagtttcacttggatatttaaatcaatcgttccaaaatgcggttatggagggggttctttatggctgcgagcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgctagatgtattcaagaatacaggaacgatttaacttatttcacaaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggattagagactaattatgatgaaatgcgaatggatattgtgtcctgtttgtgggaacaaaacccgtaataaaattaggaaggacactgttttggagaattatcccctttattgtccaaaatgcagacaagaaagattgattaaagttgacaacttgaagataactgtcatcaaagagccagacgcttaagacgcagagccgatgaaattgtggaacaattcacgaatcatcggctctttttgtttcgtatttgaaagaacaaactcaccaaataaaaaaaacgatattcgggtgggttattttgttataccctaaattaccctctgaatttgtttttaaatttggagggatttttttatgtccttttttcgggcagttatctatctgctcatacgaagcaaaatttatcaatacatagcatatcagagaacggcaggaaaccagttaaaaaaatttctgcctatgcaacggcacttcctgccttgaatgtagaagtacaatctccatacaacagaattaatatttcccataaccgtaaaggtcatagagcctttgcggtttttcttttgtcgatttttgttggaaagtgccatagggctattagtggtgttaggtgtcgttcgccacctctccatctggattttgaacatttcaaaaattcagatgggaggtacttacagtgaaatacgcaccgagaaaggtatatatcaaggaaagcggcagatatgtggaactgtcctatacggatttctgccgccgcagggaatccgaccagacctatatggacaagctgtttatccccattcaaggctgtctgcttgaagtcgtgagggagcaatacacggacttctaccgagataaggaacggtggcgttatctgaaaaaattagatacgaagaacagcctgctttctctggatggatttacggacagcgaggggaagcctttagactttatcgctgatgaagcggcagacattgcggaaaccgttgtcaatgcggttatggtggacaggctgaaagccgccctgcctttgctgtcggatagtgaacaggaattgatacaggcaatcttttttgacggactttctgagcgtgaagtcggggcgaggttcggcataacccagagcgttgtgaacaaacgcaaagccagaatcctaagaaaactaagaaagataatagaaaattaaaatttaaggcgttcagcccccttgttttttcctttgggaaaatgagggggtttttctctgccctctcaatcaattctgattggaggaaaagaagcatggcatataaccacggacgggaggacaggaaatggcgtatctggaaagaagcggaggaaaagctgctgcgtgagtgcggcgttgatgaagcgaccattgagcagatacgcattgcggacagggcagacttcaattccaacaggcggttttaccgatggacgaatgacattgcggaataccttgaggacatggcagacagggagcggcagacggaagtgggtacggttgcggagttactggacgagattgagagcgaaaatctctatcaagtattagtcgcggtggacgggcgtaccttgaaaatcgtcctgctgaaaatgcaggggtattccacaaaggagattgccccgctcgtgcatttgacgactggtgccatctatgcgaggttagaccatctgcggaagaagctacgaaaattttatagcgtctaaaacagcctgccgtcctgcgggctactgggtgagggatggaaatcccctcacttattttttgcaggaggcaagcgggatggcatacagagttaaggcgtacacgcttcgggaggaatccacggaaagcggcacaaggtattttatcagctttaaggacgggcagggcaaatcccacgagttggaagtgtcggaacagttctttatggagtttcggcagatggaacgcaggaacaggaatctcctccaatgggacgagcggcacagggagttttcggaagtatgggacgaaacgctgaacaggcgggcgttgaagctgcctaagagcatagaggaacaaatgattgaggcagaacgggcagaactgctctgtaaggcggttgacggactgccagagatacaaaggcggcgtttcctgctctactacgagtatgagttcaatttttaccaaatcgccgctatggagcattgcaccgcttcggcaatacagaaatctgttgcgattgcaaaggagaaagtaaaggcggaaatgaggaagtatctccaaccgtgaccgacaccgcccgaaaaagaaatctgttttttatttgtgtgggattggcggcattacatactctcactttttcttcgtgggagtaaatctatttttaaggaggtcaacgcctatgtgcaacgaaaacaaaaacaccgcccgaaaggaggaaagccatgcagaagttacagacagtcaacgccgaaacgctcctttatgaaccgcttgagaagccgtcctttgtggtggacagccttatccccacaggcttgtcgctgttctgcggctcacagaagataggaaagagctggctcatgctgaagctatgtttatgcgtgtcgcagggacttcccttgtgggatatgccgacaatggagggcgacgtgctttacctctgccttgaggacacgttctgccgtatacaggacaggctgttccgattgacgaacgaagcgagcaggcggcttcactttgccgtggcaagctgcaagctgtcagacggtcttatcgtgcagcttgaagattatctgaaagattacccaaacagcaggcttattgtcattgacactttgcagaaagtccgtacagcttcaaaagacaatgcctacgcaagcgactatggggacatctcactaatcaaagactttgccgacaggcattcattggcggtcattgtcgtacaccacatccgaaagcagaatgacagcgatgtgttcaacaaggtgtctgggacgacaggcttaacggggagtgcggacgctacctttgttctggaaaaggagaaacgggcatccgacaccgccaagctgtatgtgacgggcagggacacgccctatcaggaatacacgctgcgtttccgtgattgcagttgggaacttgtggagagaaaaacgcaggagcagcttgcgaaagaaacgataccagacgtcctttttcggttggtggattttatgagggataaggaagaatgggcaggcacggcaacggagctgttagccgctatgagggaaacggaaaccatacccacggtgattacgaaatggctcaatgaataccgcaccacatttttaaatgagaaccatatcgtttatcagtacagccgcaaaaaacacggcaggcagatttcgcttgcaaagcgggcgggtgacagcggtgacggtggtgacagcgatattgggataccccctgttactgtcattgacgcttaaagccgtgtaaagctggcgactctgccctgcgggtgacagcggtgacggcggtgacagtgattttaggataccctgccgctgtcatccctgcgggagaacaccccgtaaacgcaaagtgcaggcgtaggatttacccgcccttttcggcgtgtaaaaccacccctgcggtcagaaaaatccttccgatttttccgactgcgtttacagggtgtaacacactacactttgccctgcaaagtcgtgtgccagacgttccctctggactcccttatggcaggtcttacgccctgcttatcctacgctccacgcttcggataaaagaatggcagcatgacggtgacggctcttgcgagggggtattccaaaaacaccgtcatcatcgacatgaccgtcatgcagggaataagggtgacagttgaggcagtcggtagggggtatcccaaaactgctgtcaccgccgtcaccgctgtcacccaaagggcagtttacccgccgaagaaaggaagatgatgaattatgccctatgcaatcctgcgtttccagaaacgcaaagcgggcggcgttgcggcttgcgaacgccacaacgagcgtaaaaaagaagcctataaaagcaatccagatatagatatggaacgctcgaaagataactaccatcttgtgaatccgccgaggtacacctacaagaaagagattaaccgcatggtagccgaagcagggtgcaggacgaggaaagatagcgtgatgatggtggaaacgcttatcacggcttcgccagaatttatgaacagcctgccgcccaaagaacagaaagcgtattttacgatggctctggatttcatttcagagcgtgtcggggagaaaaatatcctctccgcagtcgtccacatggacgagagaacgccgcatatgcacctctgttttgtgccgattacaccagacaataagctgtctgccaaaacaattttaggcaatcaaaagagcctgtccgaatggcagaccgcctaccatgagcggatgtcctcacggtggaatcagcttgaaagaggtcagtcctcaatggaaacgaagcggaaacatgtccccacatggctctataagttgggcggcaggcttgataaacagtatgaggaaattgtgtctgcactgtccgacatcaacgcctttaatgcagggaagaagcgtgacaaggctctggaactgattgcggcatggctcccagacgtggagaaattctcaaaggaaatcagtaagcagagtgcctatatcaatagcctaaaggagcaaatcgggcaggaatcagactatgcggggcgtatgcgtgatgaaaagtatgagcaggaactaaaggtgcagaaagcgaaccagaagatatttgagttgcagagaaccaacgagcagatggggcggctgctctcaaagataccgcccgaagtgttggaagaattgcagaaaaaccataaaagcagagcgaaagaaaggtagatatgtgaatgaagaaacaggattttaaggtgttaaagaccaaagacttgtacccgtttcccgacaatccgtttcatgtggcagaggatgaaacgctgtcagaattagcggaaagcatcaaggaatttggcattgtcacgccgataatcacacgcccgaaagaggacgggaacggctatgaagtgattgcagggcagcggcgtgtccgtgcgtctgaacttgcagggataaataccgtgcctgcgtttgtcctgcccttagaccgtgaccgagccatcatcacccttgtagacagtaatttacagcgtgagaatatcctgccatcagagcgggcgtttgcctacaagatgaaatccgaagccatgaagcggcagggtttccgcacagacttaacctcgtcacaagttgtgacgaagttgcggacggacgacaaggtggcacagggcttcggcgtaggcaggatgaccgtacaaagatttatccgtttgacggaactgataccgccgattttgcggatggtggacgaggggaaaatcgccctcacgcctgcggtggaactgtcctttttgaagaaagacgagcaggaaaacctctttgccacgatggagagcgaagaagcaacgccctcactctcacaggcacagcggatgaaaagcctaagccagagcgggcggcttgacatggatacgatatttgcaattatgacggaggaaaagggaaaccagaaagaaaccttgaaaatcaacacaagcaagctgaaaaagtattttccgaagaacacaacgccgaagcagatggaggaaaccatcattaaacttttggagcgtgaattgcagaggaaacggggcagggacagccgctaatcttctcttttcgggaggtaaatgcagaaaattgaggtatgaagaatgaaagaaatccagtatgagattgtaaaggaaatcgccgtattgtctaagggcgacagcggctacacaaaagaaatcaatcttatctcatggaacggaagagagccgaaatatgacatccgcagcttttccccgaaccgtgagaagtgcggaaagggtatcacgttgaacgctgatgaagcagcagcactccttgaagcattacagaaagaagtaaacagcggggattgatggtatctgattgacagggcggggcgtttccagacgttctcctgccctgtctggaaaggaagatttaagtatgggcgaggataagaaagcagataaaaagagaaagcgtatcgtgccgaaagcaccagttcagatgataatcagccgtgaatatgtcggcacgcagacagtcacagaagcgtttatcccgattatttccgaggatattcggaagaagattgccgagggcgacaccttcgacaatgaggggctgtccgcttagaatgtacgcaatggaacatgaaaacagataggacagatatggaggttttacagtatggcaggaataagaatggagaacaagatttatgaagtcggcatgtactgccgcttgtcaaaagacgatggcacggataacgagagtgcgagcattgcgacacagaaatccatcctcacggattatgtgaaaaagcagggatggcacttagcaaaaacgtatgtggacgacggttactctggtacaaatttccaaagaccaagtttccagaacatgattaaggacattgaaagcggtctgataaactgcgttatcacgaaagatttatctcgtctggggaggaactatcttgattgcggactgtatctggaagtgtttttcccagagcataatgtgaggtatatagcggtcaatgacggcgtggacacgctcaataaatccgctatggacatcacgcctttccgcaacatcctaaacgaaatgtattccgccgatgtgtcggtcaagataaaatcggcgtaccgagcgaggtttcagcaggggaaattcatggggacgacagcaccatacggttacgtcaaagaccccgccgaccacaaccatctgctgatagatgacaaagttgcccatgtggtaagggaaatatttgaccttgcgttagcgggcaacggaatcgccaaaatccgcaagcacatcaacaaacagcatatcttacgccccgccgcttatgcggcggagcagggggcaacaggctatgagaggtattttgaggagaatgaggagaaccgttatatttggagcgagaacagcgtaaggggcattttaagaagcccgatatatgcgggaaaccttgcaggctacaagcggattgccgccaacatgaaaagcaagaaacgcccctctaagctgcccgaagaatgggaagtgataccagacacccatgaggggatagtcacgcaggaggaatttgataccgtacagcagcttattacaagccgcagattaccagaaaacaagggcggctttgagaacatctttgcaggcgttattaagtgtgcggactgcggctatgcgatgcgggctatgagtgccaacaggaggaaacgccccgacatcatcgactgcgtacaatattcctgcaataattatggcagatacggtaatatcatgtgtaccgcacacagcattgaagcgagggacttgttcaacgctgtcctcaccgacatcaaccgatttgcggatatggcagtcaatgatgaaaaggcagtgagggcgattgaaaagcggctcacggaaacagaccagagcaaggcaaaggcactggaaaaggagcaaagaaaactgaacaaacgccttgcagaactggacaggctgttttcctcactctatgaagataaggtgatggagcgtattaccgagcggaattttgagatgatgtcgggaaaataccagaaagaacagcttgaaattgaagcaaggctgaaagaggtaacggaaacgctcagcgacagctatgagaagacgcagggtgtccgtgatttcctctccctaatccgcaactatcaaggcattaaggaactggacgcaaccatcataaacgcacttatagacaagatacttgtttcggaacgtgagaaacttacagacggaatggtgcggcaggaaatcaagatttattataaattcatcggctttgtcggtgaattacatatcacaccgacaaagcggtggactgcgttaaagcctaagaattgtacggtgtgcggtgttgaatatgttccccgctctggcatatcgaagtattgtcctgcttgtgccaagaagatacagagggagaaatcaaacgagagcaaacgcaggagcagggagcgaaacagacaggcatgtattgaactgtccgcaaaaaatgaccgactgacatagaacagcaggaggggcgtattttaaggcagggaaaccttaatccgaaagtaaagattttccggtatgtgacggaaggaaccttcgattcgtacagttggcagcttatcgagaacaagcagaaatttatcggtcagatcatgacaagcaaatctccggtacgaagctgtgaggatgtggatgaagcggcacttacctatgcagaggtcaaagcacttgcaacggggaatccctacatcaaggaaaagatggacctggatatacaggtatcgaagctgaagctgatgaaggcaaaccatacaagccagaagtacagattggaggacaacatcacaaagcactacccacaacagataactattttaaaggaacgtatcagtggtatgcaggcggatattcagactgcaaaggaaaatcttccggcagataaagagcagtttaccatgaaagtcggggataagctctacacagataaaaaagaagccggaactgctcttgtggaaatgtgcaaagagataaagagtgtcaatgccccggcaatgataggcgagtatgcaggctttaaaatgtctgtatcctttgattcttttaatcacaaatttgtaatgaatgtcaaaggacagttatctcataatttggaaataggttctgatccgcttggtaatatcgcccgtatcaatcatgcactggagtccatgccaaaagagcttgcagaagcaaagaccaaactggacaatgtggagcaccagcttgaaacggcaaaggtggaagtgcagaaaccttttgcacaggaagaggagctggcagaaaaattagaccgtctgtctgccttaaatgccctactgaatatggatgaaaagggagatgatgggattggtatggatgatgatgcatcggaacagaacacttccggacaggatgtcaaccaatctgcacagcagaatggtttgaagccggagagaaaggagagtgttgcggataagccactgacaagggtgtcattaaaggaaaggttggaagtgatgaaagaaagagttttagttggtggggttgataaaacagtacatcagaaagaaaagggagttgttttataaaaagggctatttctttttgaagttatatgaaatataatagtatttcaaagatgtaaattgaaaagaaaaatatatggatatactgtaaatatctgagaataaaaataacattgaatttgtcagacactgtctgacaaattcagaaaggatatactatgaacgatttagaacaaacggatatgcttcaggtgctggttaatgagattgccgatactgtttctaacgcaaaaagagaattggcagaaaaagtaaatagtgtgatgacagaaacttattggacaatcggaaaatacattgttgaatttgagcaggatggtaatgtgaaagcagaatacggctcccgattattgacgaagctctcacaccagttgacattgcgattagggaaaggttatagccgtcctaaccttaataacatgcgtaaattttatctgtgttatccaaattgtcagacggtgtctgacaaattaacatggtcgcatatttgcgaactgataaaaattgatgatgaacttgaaagaagtttttatgaaaaagaatgttataaggaaaagtgggatgtaagaactctcaggagacagatggattcagcattgtttctaagactggctgcgagcagggacaaagagggtgtattagcacttgccaatgagggaattacttacaataagccggaagatattgttaaggatacttatacattggaatttttaggtattccggagcaggaacgatatagcgaagaagatttagaacagaaaattattgataacctgcaaagttttctgttggaattgggtaaggggtttacctttgttggcagacagtatccattgacaatcaataatatacattatcatgtggatttggtattttatcacagaattttgaaatgttttgttttaatagatttgaagaaaaattctgtgcagcatgccgatgttgggcagatgaatatgtatatgggatattttgcaaaagaagaaaatatggaagatgataatccacccataggaatcatacttagtcataataaagatgaattacttgtagaatatgcaacttatggtatggatagtaatttattcgtttcaaaatatgaattgtatttgccagatcgtagggaactgcagaaattattgaatcatattatggaacaggatataaaagaaaaagaggaatagtgtaaaaatgatacgggacatttaggtgaatcgtatttcaatttaatacagaacagtgaaaaagacaatcagaaatggttgtcttttttgtatgcaaagaaaggaaaaagcattatggcagatgaaagaacagaaaagcaaaaagtaaaagaaatcacagacaagctggaggaaggattaaaggaactttttgagagtgaaaaatacaagtcctatctttccactatgtccaagtttcacaattacagttttaacaacactcttctgattgcgatgcagaagccggaagcaacgcttgtagccggatacaaggcatggcagaggaattttgaaaggcatgtgaataagggagagaaagcaatccgtattcttgctcctgcgccatataaaatcaaggaggagagggacaagattgaccctgtgaccggggaaatgacctttgatgagaatggtatgccacagaaagaggaagtagaagttaccattccggcattccgtgcagtatccgtttttgatgtatcgcagacggatggtaagcccataccggagttggaagcacaggagctgttatctacggtggaggggtatgaggactttgtaaatgccctgatgtttgtatctccggttccgattggttttgaggatatccccggtgattccaaaggatatttccatacagaggaaaagcagattgccatacaggagaacatgagcgaaagtcagactttaaagacaatggtgcatgaggtagcacattccatgctgcataataaagaagtaaatcaggatattttggctcctgcaaaggacagaaataccaaagaggtggaagcggagagtgttgcctatacagtatgccagcactttggaatagatacttcggattattcgtttggatatattgcaggatggagcagtgggaaagatatgaaagaactgaaatcttctcttgatatcatacgccatacggcttcagaactgatcaccggcattgaaacacagcttcaggaattgcagctcaaccgggaaatggaacaggcacagagtaaggaaagtcttttgctgatacagaatgatgctctgacagagttcagcttaatcaatgtccgtggaatggacaggcaggagcttatagaagtgctttctgcaatgaatgaggatgataaattaagtattccggcatatctggaaagcaaaggagcctggactacggaacttgggaatggacagtcagaggaagtggaggagtaccaccttgatgtcagatacaataccgatacagacgagataaaggatatgaaggctgaaatggaactggataaaagagcaaaggagcctatcggagcagcacagcttttatatggtaacacagataaatacggcatttatcagttgaaggataacccggagttaagacagttccgatttgagggtacagaaagtctgaaaagaatggggattacaaaggataattttgatgccattaaaatggaaaattataacctgatttatgtgggagaattatccgagttgcagggaccgacacagggggaaacactggaagcggtttatgaaaaattcaatatagaccacccggcagattataagggacattctctttcagttagtgatattgtggtgctgcatcaggacggagagaatacggcacattttgttgattcctttggttttactaccttgccggagttcttaaaggagcagacacaagcgttagaagttgcaccggaagatgtgcgggaaacttctagacatgatgtccaaaagtcggagctggaagaaatgcaggatatggaaaacggagatgaaatcattgatcttggagatgaaaaggaacaggtacttgcggaaatgaagcagtccctaaaaggagaacaggaaacagagcttgcatttcagatagcagaccgtttcatcagcatacaggaggtggatggtggttatgagtattctattataggaactgactataaagaaattgacggagggggatataacaatccggaagtgactattcgggaagcacttcatgatatagtggatgatctgaaatcagaaccagatcacaatggtgcaaagggaaatatcagtaaggatgatgaactgataccgattgattatgatggattgatggaaaaggtggaggaagccaatcgtattcgtcaggagaacacgcaaagcagtgtggtggctgattttaaggcaaagaccggggaattattccacgatattagtgaaatgaatccggaagaaatcgaggaagctgtgaaatgccatgtgcaggcgaagattgaagagtatgatattaatgcaacaatcgaggatgttgctgtaacaggaagcagatgcaggggattagagcatgaaggttctgaccttgatgtggtggtggaactttccacagcggaacgggaggacgatttatttaatgcctttaatgaggatggacttcatatcggagaagtaaaagttgacatcaatccaattacagcccaacgcacaggtacgctggaatcctatctgccacaggtggaagaatatttggagggcgtcagacaggtaagagagcaggaaaaggagagcgcagaagtaactttaactgtttcggaatgtggagaatttcataatcttggtgagtgttatgagaatattactacggtggatgaagctatagcaatctggaagcagataccttcagagcggatgaatggtattccggcaatcggaatcaatatcctagggagaggggcggaacccttcgagtattacgagattgatgttttatctggaaagaggattgacctttgggttttggactatgttcctgatattaaaaacaatccgcaggcaatggaagtcattacggaactggtggctaaattgcccgatatggagatagatggcgtgatgagtgaagaaatggaagcaagagtgtgggaactgcgtatgccggacttgccacaggaggaacagcttgcagtagaacttgaccgacttttctacgattatgatactgtactgtatcacgatagtacaagaaatatgaccgagaatgtatcagaacttgcagaatccataaaacagggcgataccggacatttaacaacgtggcttgcagacattatttcggagggagctgtaccagaggaaataaaacgagcaacggagcttctggaaaaactgacagagtataagccgcttgccaagattgaggaggcagaagaacagaattataatatgattgataatgtgctgaataatggtgttggggagaaagcccaaagggaagaaaataagagaatggaggagaagcctccagcaagagtttccttaaaagttcgtcttgcagagaaaaaggcacaggtagaagggaaatcgaaagaacatgatgttcaggaaaatgaaaagaaaagtcatagggagatgtaagtgatgaataagagatttaccgtagaagaaagtaatttaatcagtatttttatggaagaaggtatagattcagatgtgggcggcagaaaaaaggtcataaatggtattgataaagcactgaaatatctggaggatgatgagatggttgaattgtcattatgtgtccttgtaaaattaaaggaattgacggatcatgaatttatgaagatggagtttgtagcggcagagtaacatcaaacgtaaggcagagcatggcttttggaggctgtgttctgtctttttgaataagaacttgactgataaatattacgggtgtaatatttataacgaaaggaattaaatttttttaccctaaaatcttacacttgtaatatataagcgtagtacattgatacgaataagaaatggaggtaacgatgaaggaaaaacatagaaccaaaagaatacaaagatatagaaaaatgttgagcattatagtgttgatattaacaattactttgattggagtagttgtgagtgcaacagtattatataaaagaaaaaattcgtgtaaaacaccagatactatcttagtagagtatatgatgcatattccaaaacaagaatacgaagaaatgtatgcaatgattgatttagagtcatctggatatatcagtaaggaagattttctgaagagaaattccactatttatgagggaattgaaatgcaaaacatgtcgataaaaaatgtcgagtatgtggaggaagataaaaaagtaacatatttgacttcgtttgatacagtggcaggaactatcagctttgagaatgaggcattttttataaatggagaagaaggatataaattggtttgggatgattccatgatttttcctaatctgacttctgcagataaagtaagagtttctactacacaggcagagcgaggagaaattctggataggaacggacgtgtccttgcaggaaaaggtacagcatcttcagttggaattgttccgggcaagttggaaaacagagaggaagcaatcgcacagattgcaggactattggaaatcacaacggaagtgatagaaaagaatctgtctgcaaagtgggtaaaggatgattcttttgtacctattaaaacgattccaagagtggaagaaattgagttaatgtctatcagtccagaggaagaagttttaaaggagaaagaaaggcatgataagttgctggagattcccggagtgatgatatctgatgttgaagtgcgtgaatacccattaggggaagccgctgcgcatttggtcgggtatgttcaaagcgttactgcggaagatttagaggaacatgcaggagaaggttatacagccaatagtgtaatcggcagaagcggaatggagggcttgttcgagaaagaactgaaaggccagaacggttgcaggatttacattgtaaattcggaagataaagagaaggaggaactggcttgtatcctggtacagcatgggcaggacatccggcttacgatagatactgatttgcaggtttccttgtacgaacagtttaaggaagataaaagctgctcagtagccataaatcattataccggagaggtattggctttggtcagcacaccggcctatgacaataacgattttattatgggattatcgagtgagcagtggactgtacttaacgaggatgagaataagccaatgtataatcggttccggcaagtgtggtgtccgggatctaccttcaagccaattatagctgcgattggtttacaatcaggagcaatcgatccaatggaagattacgggaacgtaggattaagttggcaaaaagatgcatcgtggggttcatatcatgtaacaacgcttcatgcgtatgaaccagtcattttagagaatgccttgatttattctgataatatttatttcgcaaaagcagcattaaagattggatcggatgagttggagaattctttgatacggcttggtttcaatgaggaactaccatttgagattaagatggcagaatctcagtattccaatacagaaggcattgaaactgaaatacagttagctgacagcggttacggacaaggacagattttagtgaacccgttgcatatggcatgtatttattctgctttctgtaatgagggaaatgtaataaagccttatttggtatatcagaatgaagcggaagctgagtattggattccgggtgccttttctaacgagacagcaagtcgtgtattggaaggaacaaagaaggttgtgaatgattctaatggaactggatatgcagcccatcgagatgacattcttttagcaggaaaaacaggtacggcagaaataaaggcatcgaaggatgatacttcaggtacagaattaggatggtttgcaatttttacagcagaagatacggaatgtcctatattgattatcagtatggtagaagatgtgaaaggaagaggaggaagcggatatgttgttaagaaagacagtctggttctggaagagtggtttagcagtcattagttttgtactgatgtttagtatttcggggtgtagcgatacaccaccggaagaagatacagtttcggaaacagtaattgatgttcaggacgtttcagaagaagaacaggagaatgaagaagaaattataaacatctgcatagatctttatgacaaggcagcagaggaaaataagttagatgatttggaaataattcggagtattgtaaatcgtcttggagaaaacgagtatcctgctgttgacagcagaaatcaagtgaatatgacggaagcggagcaggtactggaattttgtgaaaaggtggatgcacaggaagaagcagatataacgattcttgaagtcggctatttgggcggatttgtaaaatacgatttgcacacaaaagacggaaatgtagatgtggtcagaagctattatggatacgaaaatggagaaatacagaaagaagttactgggaggtatcaagcagagtattggaattatacagaagaaggttacctgatgttttctggtgtctggttttcagaagaattatacgttcttacattgagtggagcagaggagcataccgcattacgagtacagccattggatgaaacatatagggaactgagtcggaaatatcttcttccaatcagctttgaacagaataatatgtttattgtggattggagtgaagaagattttggggatttgaatttctatgatatgtatgacattctttatccaaaagtgaatggtcagtatgttccttatgttgcagatgacaatttgtcagtcagtgcagtttatcggattccaaaagaggaatttgaaagcgttattatgaaatatttcaatattgatagtgaaacgctgcaatccaaaactgtctatgattcggaggattcgacctatgaatacaaaccgagaggcttcgaagaagtagagtatccggaatacccatattcagaagtaatcgggtatacggagaacagtgatggaacaattacacttactgctaatgtggtatttccatattcgggaaattccaaagtatatgcccacgaggttgtggttcgtcctttggaggatggcggggtacaatatgtatccaatcgaattataccctccgaggataattctgaggaaacatggcatacgccacggttgacgttagaagaatgggaagaattatacggagacgaataatggaagatgtgaaatggctgcttagaagatgtggtcttccgattttgctgctgttgattttcgtaatagccggagtggtctgttggggagaactgcatacagaaaagcaaaaggtggcagaagaagtatgggagccacctgtagaaatcgaaaatagcgaagcagaaacagaagaagccgagaatgcggaaacttccacagagtcagcatattggtttattccgcaagccagtgatgatctccttacagaagaggagaaggagcaactgcagagtacggttttgtcagcagcagaatcggtcagagaaatctataaggatattgtaattgcagatgcactaagctactcttccggtattagcgaatttaccaaagagcagaggaaagctgtggtggagcaattgggcagaaccggtctggtaagtgttgaagaagatgctgctatgcaaaatcatgaagcaatcgaagcattttatgcagattacctggatggacaagactcgatggttacggtatttgaagtacagagagatgggctgattggagcagttacctttatctatcggaaaggtgagttgcagacctattacataggaattcggtggagagaaggtggtatgccagaaatacagggaacttcggtaagtaatgtggctgagattaaactgaccgaaaaaggatattttatctacgcatatgaatatgtgattgcacatgcaagtttgagacagtattggagaatagaaccgctaccagaagactgccaggaattaacggagaaatacatatcaggactaagttatgtgaattacaatctgctcgttacagattgggatagcagcaatgtggaggacattctgatgccttgtatgtatgaagatgtttataggatttctacgggggaaaatctgaaaactgagggttggaagattccggcagaggaatatgaaaggataatgactacttattttccggtatcggtagaacagttgagagagcattgtggatatgatgagggcagcaatagctatgaatatgagatgatttatgccagtccatacccacctttcggagaagtagttgactatacaaaaaatgcggatggaacgattacacttatcgtggatggagtatggccggattataattctgatctcgcttttcggaatacggttgtggtccagccatttgaagacggaactttcaggtatctttccaattctatagaacaaatagagttggaactgccgccaatagcaaaagcacattaaatttgctttgaaagaaaggatgatattatggcattaaagaaaaaaagcattttgctgattatggcatttctgattggatgcttcgtatgtgcctgtggaaaagaagatagtattgtggatgaatttcttgtggaagatacggaagatgtatcttccacggaggagataaaaagtgccgaggaagaggctgcagaacaatgggaaaagggctacgaccttccagtagatgaacaggaaagggaagaagctgagactgactgtaaaaagcagatggaactttatcttgacatttatgaaactgcagataaagggatagcatctaatgttgctttggatgatcaaacggttttggaaatgcagaggaagctaaaggatgcaggatgtccggttacaacaatggtaacatattctaacatggagaattatgaaagtgttgacagttttctgaaagaatgtatggaagggaaaagtggttctgcagtaatttatgaagttcacaacgatggtggattgggcagaatgaaattcatttttgatggaacagatatgtatgttgtaagtgcaaaaggaatctggaatgctgataataagccggggatttcatacatttcctatacaagactaaaagagtggaaatatacagataagggatggttctgctacgagttgtgtgtaccggagccaccagaggtcagtgagattatggatggaagttgtctaataaggataaagccaatgacagaggaacagcgtgaaatgtctgaaaaatgcgtgcgtggtttgggatatcagggaaataacctcttatgttccaattgggatacagagcatatggaagaactggattataatgggatgtatgaatatctgtatgcaatgaaataccaggaaaagtttaattctgagaattacccaaatggaataccaaaagaggaatttgaaaatttaattatggagtatcttccggtgacggcagagcagatacgggaatatgcggtgtttgatgagaaaaaccaaacgtattattgggcgcgacttggatgctttaattatgcaccgactttctttggaacttctctgccggaggttatcgacatcaaagaaaatgaggatgggacaatcacattaacagttgaggcggtttgcgacatggtcatttgtgatgatgcagtcataacccatgaacttacggtaaggtttgcagaggatggcagttttcagtatttggggaatgaaatcctaaatgacggaattatgcacataccagactaccaatatcgaattaaagaatgatttgataatagttgtgttttgtggtaatcttacatgcgtaagaaaagaaaggaggacacatgaaaaaattaaaagtagttggaatattggcagcagttgtattaataggaggagttgtttcaattccgcttataaataaccatacagcctataaggtggaaaagacattatgtgaaattccgctgccagaggaaacggaattgatagagtcactgtcacaagcagggaagctgacaggaaacggaaatggaatgcagtatttcggagcaattctaattcgaagtgacttgtctttggaagaattggatgcttactattcaaggtacagaagtaatgagtgggaatgtttggtgaaaattcaggaagggcagtccattgaggggattgatcacgggacactacaatttgcggaagaaataaaggacaggggttattacattgtatattcttggggaagtggaaattctctattggatgaattggatatacgtggacactaaaaaggagcaagatgaattatgaaatatatttccaaaatcagtaaaatcagtagcttcatattttacatatttctattgtgccaattatggcatttatgccaatatggaatcattagaagtcattttttcggagtagttatttgtacagtaggttttacagcggcagttattgtttggttggtttcaagaaggaagaagttagaagaggatacggagaggataattaacgattgggggattcctttttgaataggaatctcttaacgcatttaagggaaggatggagtaaaaatgattataaagtctattatgaccgatgaagatagaaaagcattagagtatatgctttcgttagaatatgctatgccatatcaattacttaagacaaaaaataatagaaggaaaattatttatataatgacaccagtattatttttgttatcaatcggttgctattttgtaaagagttatccgatgttttatgtgggaatggggatttctattattgcattgatttggattatttggtttcaatctaagggaaaaaaatttgaaaataatgtccatgaatttgtatggaataaatcaagatataacaaagtggaaattgatgttcagggaataaaattagaagataaaaagatctgcgaacttaaagaaatagatagagtctttttgtacaaaggttttttctttctcataacgaatgaaaagaagttacttgtactaaaaacagtaggtgtagagacagaagaacttattaagattattaaagaagctgatatcttatttgaaaaaagagaagaaccatttaatatttatgaatattgcaaaaagtagtaattaaaaaaagaaaaaacatttaatatttataagcctcgaaaaaacgagtaaaagttaattctacagttaacctttactcgtttttgttatttctgtgatacccagatattcatgtctgataagatagacatggttatttcagttgcgttgccgccagtagcatcgctgtctgcactaatgttggtggcaaaaaagtatgtattatctgcagtttcgatataaccgatgaaccatccattaatatcctgaccatttacacgtccggttccggtctttccgtagaatgttccggcatcggaagctgaaaggcagatggcatcttttactgcattgatattttcaggggcgaagccgaaactgttattctgcagcttggttaaaagttcgacctgttctattggagagatttccaaggaggattccatccaataagaggagaaatcgccactcatgttttcgttaccatatccgatttcttgaacatagctgtaaacgtcagaggctccaagctgttcatctactgcttgaaaataccaattcacagaggagttcattgcagactgtaaggtctgatctgcgttccatgcttcaaatggataggtttctccattccatgcaatgaacgaattttccggtgtaatgacgccttcttccaatccgaacaaagcatcgtatatcttgtaggtggagtttggagcaacccgtaaggtggcatgctccatgtcatgtatactccatgcatcgttttccaaatcgtataaaacaaagctgccttcgtattctccgaagtatgtggagaggtctacataggaaatattctcagaagaggaatcccattggtagtggcttccatctgctgcgtatgtagaaataaaaggtgcgaatccaaggagaaggacagcagtcaacatgaatgcagtcataccttttactctttttataaatgtcggcttctcataagatacaatgttgataattctccgtttcatctgcttcatgtttccaccaagaccggcggcaaacggaaatggagtaagtgaaatcttttccgcaaaattgatcagtgtattaccataatctgcataatcatcctcctcaagcatctttaaaacagaggtgtcacaggcaacctctctgtcattgcgcatttcttttagagcataccagacaagaggattgaaccaatatattactccggcaaagttcattagatagttggcaatagcatctttgtgcttatagtgctgtagctcgtgtaacagcatgtatcgcatgtccgattcgttataatctgagatgagatgaatcggcagataaatacaaggtttcaaaagccccacaataatcggagatttcaaaaatgcagtactgtaaacatggatatttctgttaattcccatttctttcatacatcgatgatatagttttcggacttccgggttctgaaggggaagtgcagattttttcaagttctgtaagcggatagaggatttgattatcaatataatcattgcaaggatgcctacaagccatattccaaatagtatgtatccgatgctagatggagtctcactatttaccgaaagggcaaagtcattcatccagtctgcatttccggctggattgatcccaacagcttctcctatggcggttctggtgccagaagtaggagaacttttcaggctactgagccacgagaggatttgcggaaacccaattaaacggaacggtataaaaggaactaccaacaatccaagtagcaggaaccacagattatactgcatccggctggataggttgcctttgaatatccgcttggctatcaaaagaattccgatgataccgctgataaatacattgcatattaaaaagcgtatcataaaatcagccatgttaattacctcctttttttgacctcttggaaagaagagagcggagagtgtctatttccgtttcggacagtctgtcattttctatatatgcagacagcatggcagtgatgtccccatcgtagtatcgttctagaaaagagttactttcctgaccgatgtattcactttctttcacaactggagtgtaaacaaacacccgactttgtttttcataagtcagaacgcccttgttcactagacgtttaattagagtttgtattgtttttggactccagctcgtagtctgtaataatttatcagttatttcattggtgctgatcggcgcatgtttccatacgattttcataacttcaaattcagcttcagaaatctgtggtaaatcgctcatttcaaatccctccttaaatcttacggctgtaataaaaatattatagatgttatttgtgtagttgtcaatttaagagaaaatagattgacttgaaatcttacttatgtaataattaaaatattacacaagtaagatataaacaaaacatgtacttaaattaagaaaaccaacagtgtcacatggattccattggttttcttaaagggttggcttgttgtgtgttcgcatcaaattgagtagatagcgaacggcaggaatcagttcttctgattcctgttcagtgcaatcatccagcagagcaaggagtctttcatgatttgggcgaggctcctttctgtcaggatagaaaattttattgtcagtcagattcaagtaccggataagggcacaaagattttcaaattttggattgccacgtccgttttcaatgttgagtatggtacggctgtcaaaagctaaaatttcagcgagttgttcctgcgatagtccgagtttagtgcgagcttctcgcactgcatcggcaagattttgttttatgtcctgcattgtaattcacctccagagtagtttacattacacattaggaagaatgaattactgtacaatacagttttaatatggagtaaaatacataatgagaaagaagaggaaaagatataggtacatattattaaatacaaaaatgaataaggaatactacacacataatggtgtattgcaatagaggaaaaatacctcgttgcaatacaccttttttgatgttgttttttacagagatgtttgattctgttccggcttgtattcagcggaatgtatcttctccagagtccggtcaagatactggtttatgttctccagttttctgctgagatttttaatttctttttcggcagatttgtaggtgttctgtaaagtttcctttttggaatacagagcattgtatttgctgcggagtttgtcaacatcaagggtttttaggttaattccaaagcgttttaacatattttccgcaccgtcatgaagcaggagttctgtttcgtgtctgtgtaaataggcgtccggatcttttgatttctgataacgaacgtgatagatgtgattgactttgtattgttccgcatatttcaaaatcagtcctaaatcttttagctgatgctccgtttctataaggttgcttcttgcagtttttgcaaggagtgacttggtagcaagctgtttttccagctcggtaatggagtctgcactactgtagcttgcggctgctatttttagattttgaatgtcagcccaatgctttaaaccgggactgtgttcaaattttccctcagaggtgtcaatgagccttttggaagaaaagtctctggcaataggttttgattttcgaggaaaaggaacacgcttttgtggctgcaccagactctttgattcgatacgttctttaatacgctctttggtgtattccacccccagagatttgatgctgccacggacaaaacgttctctgtcaagagggcggaaggcaatatattttaagtcagattcagcaaaggtttcgccttttatttcataaccttttgcccgaatgagttcaagaaaatcctcataagaatcggctgcccgtacagcttcatcaatgtctgttttgagcttggctttccatgaagaaccgttgttgtcagaaagccatttcctgtatttctttccacgttgctcagtgggagaaatgactgataactgatgctcgttacatagttcatcatttaacttccggatatggtaataactctttttacaatcgtgatatttttcatgattgatgttatctgcagcacagaaaatgaggtggttatggacgtgttctctgtcaatatgggtagccacaacataagagtattttccttccaaaagtttgtcagcaagctctatgccgatttgatgagcttctttataggatacctcgccgggcatgaaagattgtatcagatgaaaggctttgtttgaatcagcctgattggtttttgacagggaaaacttgaaatcataagctgccgtttcaggactgcatccaaaggaagaaatgaggatactttcatcggtttttgcagggttgcaaatgtaagctactgctttatggacggttgctttgatagcatggatttttgtgattgccatacctgtttcatcagctcctttacttctttgacatcggcttcatacacattcccggttgcgttcatccgcttggcaatctggtttaagttattgccgatacgggcgagaagtgtgttgtattcccgcaagtgttcatagtttacgtcatagacatatccgtacagaatcatgtgccggataaaggcagatttgcttttcatgccggagattttaaatttctgttcgagtatgtactgctcgtcatcgctcagatagattttcagttcgttttgtcgttctctttgtgccattgcttcatcctttccatatttaagatagaagattttgtaatatgccgtttccggcggtgagtatttttgtgtactaaaatcagaaattccggtttggcaattactgattttggaagcatcagggggtcagggggatatgcccattgcaagccaattttttcaagtttctgaatggcaggaacttgtggaaatggtgcctgtgagggaacacaggcagtgcttgctatctttggcaaactgtccgtaggaagtttgcgtgttgtacgagcttaggcgagtgttcaacaacacataaggacattattgtccatttttggactgcttttatgcggtccggctttgtagagctattggcataagcaataaaaaactgctatggcttattgcaggcaagagatgcccgtgaagctccatagcagtttgagtgtttttataaatttatgattttatccataaaagattttagcaacagaaaatagcaaagtcaataagagaaagcggagaagataggaacttttggatatgtaaaaggaagccctgattgtatcgaaagcgattaggagaaaaagcttatctgaatatgaaaggttttttccggttcattttttacaatgagataggagaatttacagaaaggaggtaaagcatgaatacagcaggtcgcagagctgaaataattagtattctaatggttagacgtcgcatcacggcgaaagaattggcagaagaatttaatgttaccgttcgcacgatacaaaatgatattcaggctttatctcttggttttccaatctatacaagacagggaggagatggtgggatttttgttggggataattacaaaccatatatgaatacattaacaccacttgaattgaaagttttgcatgaaatgtatgggctggcagatggaatacataaaaaagttttatttcagcttatccgcaagtatgggccggataaactggaactctaaacttgtcattcttgtaaagcacataatttttacaacaccgttcatagcagacggaagtggtttatgtgctttttggactgataagtccggagttgattttatccaaaatgcaggcggaagcctgtaagtgtaccttgacaattttatagacaaatgcgtgcaggacgtgtggaatatgtggagccactatgcggatacgccaagagctgtctgctttcctatacaaataaggaaggttcttatatgaagaaatgctgaaatagggtattgaagtaaagacaaggagcgataaatgtctggcaaaaagtgaagcagttgcacagggcgatgatacatatttttaataatgatacttccggagatttccggtcaacaaggattgacggtgcgataccgatgtgggcggtgtaatgagctgccacctgtactgtatttttaaaaagatttgtctgctgatgagagttgggaaaagttttcgtggttgtcatgggcagataaagtcatgcagagaattagtgaaatggaggtgttggcgataaatacaaatataacagcaggcaaaatgtctgtgccgatatgggaaaagtatatgctgactgtagatgaagcagtacagtattttgggattggagaaaagaagataagatcattgattgcagagaatatggatacggaatattgttttacggttcaggtggggaataaatcattgataaatagacaaaaatttgaaacttttcttaatcagattacatccctttgattgaaaaaacaaagataatttaatactttaaagtggaaaaagaaagcctggtatgatataattgtcctatcgtgctagggtttcttcgtggaaaggagcgaaggcgtttgaacgaaagaaaacgtgaccagaaaagacgagataaaaagggtcgtattttgcgtaacggagaaagccaaagagcagacggaagatatgcgtttgtatatacagattgttatggaaagcagaaattcttgtatagctggaaactggagccgacagattccttgccagtcggacgtagaccttgtcagtcacttcgagaaaaagaaaaaattgtcctaagagaaatagaggatggcattactccttatgggggcaatttgacagtccttgaactggtaaaaaagtacattagacaaaagacaggggttcgccataatacacaagctaattacaattttgtaatcaatattattgcgaaagaggattttgggcagaagcgtattgataccattaaattgtctgatgcgaaagaatggttgattaagttacaggcagatggcagaggatacagttctattcacagcatacggggagttgtcagaccagcttttcaaatggcagtagatgatgaacttttacgcaagaatccgtttgaatttcaactatcaacagttgttgttaatgacagtgttaccagagaagcaataaccagaaaacaggagagagctttacttgagtttgtcaagaatgataaacatttcagcagatattatgagggcatttatattcttttcaaaactggactgcgtatttcagaatttgttggtctgcaaaagtcagatattgattttgaaagtggtacaataagggtggatcatcagttacagagaaaaagagatatggagtacattattgaagacaccaaaactccagatggcgtaagatttctgccaatgacaaaggaagtaagagagtgcttcgaatgtattattgccaagaaaaaaagaccaaagatagagcctacggtcagggataagaacggaaagctgtatcatggattcctttatctggataaaaatgatatgccaatggtagctctgcattgggaaaaatattttgaacatattataactaaatacaacagcatttataaagaggaattgcccaaagtaacacctcatgtatgtaggcatacttactgcagcaatatggttaagtctggaatgaaccctaagacacttcaatacctgatgggacatgcagatataggcgtaacattgaatacatacactcatgtaggtcttgatgatgtaaaaaacgaaattgaccgagttactgcattatcgtgtgtggaagcataggaaatgtgtacaattaagcaaaatcctaagtggaaaagtctttagtaaaatgagaaaatcgagatgttttactaagatttttactaaatttggatgagaaaatataccaatttatgccactatatgcgaagaaaaagcggaatacgttctgccggagaatatcatagaagtggcgtaaatacagcgttttaaggagttttagagcattgattagagtattatttatctgccacggcaatatatgtcgttcaactttatcagagagtgtatttacttataaagtaaaagaattaggtttgtccgacagatttgtcatagacagtgctgcgacaagcacagaggagattggaaatcctcctcacagaggcacagtaaacaaattaagagaaacaggaattccattagtgcctcatagagcaaagcagatttcgttgtcagattatgataagtttgactatatcatcggaatggatactgcaaatatacgaaatttgaaccggatattaaagggagacccagagggaaaagtgtacaagtttctttcttttgcaggttcgggaagagatatagcagatccatggtatacaggtgattttgatacaacgtacaatgatgtaattgagggatgtgaaggatttttagaatatctgaaacaagaaaataaaatctgatttaaccgaatcaagtaagttttctgttttaattgtaaaaagtaataagtagagatagaaatttgctggtatcaggttgactgaaaaacggggaaagtaagagtggtttttgctacttactttccctgtttgattatttcaataattcttctaagtcagcttttggaacaacgccaatggattttttgtaaacttctccatttttgaaaacaacgatagctggaattcctgcaattctatagcgtgatgcgagttccggtgcttcatctacgttaacttttccgactttgtaagcaccgtttgcttcatttgccagttcttcgacaatcggagcaagcattttgcaaggcatgcaccatacagcccaaaaatcaactaaaacaggaacatcagagtttaaaacttcttcttcaaaattttcattggttaatgtaatctccataatttacgtctcctttataaagttagtaagaataaaaaaagttacttggtatttttaataaattttactgcctttgtaccagcctgtgcgccttcgtacacggctttcgcaatttgcatcatacctccggtgcaatctccggcggcaaaaaagccaggaagcattgtggaagtatctgtctcaatcataatatgattgtcttttaaaatcaatcctaattttttggcaatgtcggtacttccggcacttccaagagcaacaaataatccatcaatgttaagttttgagccgtcttcaaaagtaatccattctaaggaattttctcctccaacggaaagcagtttcttatgattgacctgaatgtttccaagtacagaggaatcaaaagtttcagtcagtccgttggtaaagatagtcacggcttttgcaagaggttcaagaacttttgcttcgtgaagcgcatagtctccgtttccaagaattccgacatttttatttcggaagaagaaaccgtcacataccgcacaataactgatgccatttccttcgtattttttggcttcttttaaagtaatcggatttcgttttgcaccggtagcaaggatgattgcctggctttcataggaatgaaaagaagtctgcacttgataaacaccgttatcataagcaatcgaaagaagttcttcttctgcaacaggaatattaagtgctttaagttgagaaagaccggtttcgtataatttttcaccggaaatgggagtgggaagtccgtaataattttcaattatggaagccttttttaaagcaccaattccgttatgaatgaccagtggtgttacgccaagacgaatggcataaagggctgctgaaactccggcaggacctgcaccaacaatgataagctgtttcattttttcatcacatccttttttatagaattaatgtgttttgctcatctctaataatcgtagtatcaaataaagagagattgtttctattttaccacaaattccaataaaaaacacgcaatatcagaaaaaaacgaaagagaaaaaagaaaaattatatgtaagattacacaaaaaataagcctttttttgtgtaagggggcattttttggaaattggtaaaaccaaaaaataagcgaaaatactaaaaataatattaaaatagcaaaaaaaacgtacaaaatacaggagataatccggctgtatactgataggtacacaaaaagcaacgaaaatcactagccaaaatggaagagaaacaaaaaaaattaccgaaaaacagacgaaaattggggaaaacagagaagttgtcaaaagattgacaaaaccattttttgggagtaaatttagacacgaattagagtatgaagaaaggagttttagacaacaaaattttagagaaagggaggatgtcctacggatatagcggaaatgattacggaggagcttaactgcgaaaccgtttttaccattccagtttttggtggtataccagtaggagagtctactgttgtcacctggattattatggcggcacttaccattatctctattctattagtcaggaacctgaaagtggaaaatccaggaaaaaaacagctggcattggaagctggaatcggtttcttacaagatttcttcacagatatcttaggagagagaggcaagcgatatgtaccgtatttgattacggtggccatctatataggcgtggcaaacttaattgggcttcttggatttaaaccgccaacaaaagacttaaatgtaacagcaggtctggcaattatgagtatttgcctgatagaatattccggatttcgtcaaaaaggactaaaaggttttgtgcatagttttgcggaaccgatggcaattgttactccgattaatattatggaaattgcaattcgtcccgtatccctttgtatgcgactttttggtaacgttatcggtgcttttgtcgtaatggaattaattaaaatgattattccggttgcaataccggtgccgctcagtctctattttgatattttcgatgggctgattcaggcatatgtatttgtatttttaacatcgctctttattaaagagcaaattgaagagtagttaatgaagaattaatgaagagtaatcaaaaaaaataagaagcgaaaaggagaaatgaaatatgttaacagcaattggtgcgggtatcgcagttttaacaggtttaggagcaggtgttggtattggtcttgcaacttctaaagcagtagaagctattgcacgtcagccggaagcagagtcaaaaatcagtaaagcattgttattaggttgtgcccttgcagaggcaactgctatttacggtttcgtaattggtttgttaatcttattcgtaaaataaggaaggcaggtgaagacaggtgctgaagttaggctgggaccttctctggaccattattaacctgattattctttatctcttaatgaaaaaattcctgattggacccatcacaggaattatggaaaaaagaaaaaatcttattgcacagcagtttaaagacgcagaaacagttcaaaatcaggcacaggaaatgaaaacacagtatgaaactgctttaagtggtgcaaaagaagaatctgttcagattattgccgatgcaagaagtgatgcgaaagcacttggcgaacgtactttaaaagaagcaaatgaaaaggcttcaagaattcttgaaaatgcaagaaatactgctgaacaggaaaaacaaaatgcaatgtcaggtgcaaaatgtgagattgcagatttggctttggaagctgcaaagaaactgcttagtcagggaagcagcaaagagggcaacagtatgttatatgaccagttcttagcagaaacaggtgatacagatgacagaaactaattatgcaaaagtgttatatgaattaaatatagcaccagaagtgacagcgtctgcaaacgcaatactgaaagcagcccctgaagtatcagaggtactttctagtcccgttgtttctttaaaagaaaaggaaaatgtgattgataagatttttccaaaagaaatatgtaatttcatgaaggtgttgtgccgttatcacaaggcatcccttgcacaggagatttttaaagaatatcaggagtattacaataaacgacataatatcttaaatgcagaactattttatgtggtagctccgaaaaaagagcagttagatggaatgaaaaacttcctatgtaagaagtaccacacgaaagatgtgcagataaaacaaatcgaagacaaatctttaattggaggattttgtattcgggtagaagatgaagaaattgattacagcttaaaaggcaaaatcaatgcattacaacaaaaattaacctggaggtgaacggtttgagttcaatcaattcagaagaaataatttccattctgaaagaagaaatagaaaatttcgacatggcaactggcgtccgtgaagtaggaaatgtaatctgggttggtgacggaattgcaactgtttacgggatagaccacgcaatgtatggtgaaatcgtgacttttgaaaatggcgtcaaaggtatggtgcaggatatcaaaagaaacgagatcggtgttattatctttggtaaagacacaggaatcaaagaaggcactaaagtagcacgtacaaagaaaagagcaggtattccggttggcgaaggctatatcggaagagtggtagatgctctgggtgctccaattgatggaaaaggtagtatcgaagcgaaagattaccgtccaattgaaaatgaagcaccaggtattattgaccgtaaatccgttaccgtaccgatggaaacaggaattcttgctattgactccatgctgccaatcggtcgtggacaaagagaattaattatcggtgacagacagaccggtaaaacgtctattgcaattgatactattttgaatcagaaaggcaaagatgttatttgtatttatgtagcaatcggtcagaaagcttctacgattgcaaaattaactggaacattggaaaaatatggtgcaatggattacacaactgtatttgcagcaacggccagtgactgtgctccgctgcagtatattgttccttattccggaactgctttggcagaatattttatgtatcagggaaaagatgtattaatcgtatatgatgatttatccaaacatgcggttgcatatcgtgcactttctctgttgctggaacgttcccctggacgagaagcttatcctggtgacgtattctacttacactcaagacttttggaacgttcaagtcgtttaagtccggaagcaggtggaggttccattactgcacttccaattattgagactcaggcaggagatgtttctgcatatattccaacaaatgttatttccattacagatggacagattttcctggaaagtgatttgttctttgcaggtaatcgtccggcagtaaatgttggtgtttccgtatcacgagttggtggtgctgcgcagacaaaagccatgaaaaaagcaagcggaagccttcgtattgatctggctcagtatcgtgagatggaagtctttacccagtttgcgtcagaccttgatgatgcgacaaaagaacagttagcttatggaaaatgtctgatggaattattaaaacagccactttgcagaccgctttccaaccatgaacaggtcattaccttgtgggtggcaacacataaagtcatgctggatgtggaattaaagaaagtaaaagaattccagatggatatgctggcatattttgataagaactatccggaaatcggaaagcagattgaagagaaaaaagttcttgatgaagaacttggaaacaagattcttgaagtagcagaggaatttaaaaacaagagcaggtgatagaatggcaagtgcaaaagagattcaaagccgaataaaaagtattcaggatacgatgaaaattaccaatgccatgtatatgatttcctcttctaaattaaaaagagcaaaacaggtattatcagatacagagccgtatttctatggaattcagtcggcaatcggacgtgtgctgcgtcacatgccggaaatggaacataaatattttgacgagcgttctgacattccaaaagaagatagaaaaacaggatatattgtagtctccgcagataaaggtcttgcgggagcatacaatcataatgtgtttaaaatcgctgaggaatgcatggaaaaggaagcccatccacagttgtttgtacttggagaggtggggcgtcagtattttgccaagaaaaaaatggatgtggatatgaatttccgctttacagtccagaaaccgacgatgcatagagcgagagtgatttccgaggaaatgattgagcgttatttaaagggagaattggatgaagtgtatattatttatacacgaatggtaaatgcagtcagcatggaagcagaaatgagccagcttcttcctttgaaaaaagcagatttccatacaccggctcaggtaatggtagacatccatcaggaggaaattgaaatggttccttctgcagaagaaattttaaatagcatggtgccgaactatctgcatggttttacttatggatgcttagttgagtcttatgccagtgagcataattcccgaatgatggcaatggatgcggcaaccagcagtgcaaaggacatgctcaaagatttatcaattcaatacaaccgtgtgcgtcaggctgcaattactcaggaaattactgaggtaatcggcggtgcaaaagcacagaaaaataaacattaaaaatacagaaaggaggattcctcgtggaaaaaggaaaaattgtacaaatcatgggaccagtcgtcgatgtggaatttccacagaacgcacttcctgcgattaaagatgcccttactgttgagaataacggaaaaaaactggttatggaagtagcacagcatatcggtaataatactgtacgttgtattatgttggcttccagtgacggtctttataaagatatggaagtaacagcaacaggtgctggtatttctgtccctgtaggaaaagaaacattaggtcgtctttttaacgttttgggagaaaccattgataatggagaacaattagataatgcagaacattgggttattcacagagacccgccaagttttgaagaacaaagtccagtcgtggaaatccttgaaacaggtattaaagtaattgacttattagcaccttatgcaaaaggtggtaaaattggtcttttcggtggtgccggtgttggtaaaaccgtattaattcaggagttaatcagtaatattgcaaccgaacatggtggatattctatctttaccggtgttggagaacgttcccgagaaggaaatgacctttggagtgaaatgaaagaatcaggagttcttgaaaaaactgcgctggtgtttggacagatgaatgagccgcctggctctcgtatgcgtgtggcagaaaccggactgactatggcggaatatttccgtgaccaggaacatcagaacgtattgttatttattgataatattttccgtttcacacaggctggttctgaagtttccgctctgcttggacgtatgccgtccgcagtaggttatcagccgactctggcaactgagatgggtgaattacaggagagaattgcatctacaaaaaatggttctgtaacaagtgtacaggcagtttatgtgccggccgatgacttaacagaccctgctcctgcaactactttcgcacatctggatgcgacaacggtattgtccagaaagattgtagaacagggtatttatcctgccgttgatccgttggagtcaaactcccgaattctggaagctgatgtcgttggcgaagaacattatgaagtggccagaaaagttcaggaatatctccagaaatataaagagctgcaggatatcattgcaattcttggtatggaagaactttccgatgaagataaaaaagttgtagcgcgtgcaagaaagattcagaagttcctgtcacagccattccatgtagcagaagtatttacaggtattccaggaaaatatgttccgttaaaagaaacaattcgtggatttaagatgattatcgacggtgaagtggatgattgtccggagagtgcattcttaaatgccggaacaattgatgatgtcttagaaagagcaaaagcagaacaataggggtgatgtatagatgaatacattcggattaagtattgtggccagcgataaagtgttctttcgaggcagagggattaatattgtaattcctgcacaggatggtcaggtttcgattctggctcaccatgcggatatgatgattacggttgttcctggagagatgcgtttccagacagaagatgaacaatggcatgaggcaattgtaggaaatggctttgcccagattatcaataaccgagtgtcgttgtttgcggacagtattgaaaaaccggaagatattgatgagaaacgtgcaaaagaagcattagagcgtgcagaagaacagcttcgccagaaacagagtatgcaggaatattatgtatcaaaagcatctcttgcaagggcaatggccagaatgaaagcaagtaagagacatgagtaaggaaagtgtggagagaaaaaggctttctctccacctttttttctacaataaaatataactttgagttatgatttgcatactaattagttataacgtggcaaatccattgacaaaaaaataaatagttgatagaattacaagaaagttaagcaatgattgcttgacaaatgaaatggggagaaggtgctgtatgaataaaagaattttatcaattctggtagaaaatacggctggtgtcttaagtcgggtttccggtttgttcagtcgaagaggatataacatcgacagcctttccgttggcattacaacagaccctaattactcacgtatgactgttgtgtgcagcggtgatgaactgattcttgaacagattaccaaacaggtggaaaagttagaagatgttctcacagtaaaagtgctgaaggacggtcagagcgttaaccgagaattgattcttgtgaaagttcgggtagaaccgaatcagagagcggatgtttcttcgattgtagatattttccgtgcaaatattattgatgtgggaaaagagtccatgattattgaactgacaggaacaaaatcaaagctggaagcatttattgatttgttagaaggttacgaaattttagaacttgccagaacaggtatcaccggtctttcaagaggggtagatgatgtattctatcttgaagaagacggggaagattattaattaagttagctagagaatgattttttattccctaagataaaaaaacacaaaatgctaggaggaaacaaaaatggcagtaaaaatttattatcaggaagattgtaatttatctttattagaaggaaaaaaagttgcaattatcggttatggtagccagggacatgcacatgcattaaacttaaaagaatctggtgtagatgtaatcgttggtttatatgaaggaagtaaatcttgggcaaaagcagaagctcagggattaaaagtttatacagcagcagaagcagcaaaacaggctgatgttatcatgattctgattaacgatgaaaaacaggctgcaatgtacaaaaaagacgttgaaccaaacctggaagaaggaaacatgttaatgtttgctcatggttttgcaattcactttggacagattaaaccacctgcaaatgttgatgttacaatgattgctccaaaaggtccaggtcatacagtaagaagtgaatatcaggctggtaaaggtgttccatgtctggtagctgttcagcaggattacacaggaaaagcattagacaaagcacttgcttatgcagctggtatcggtggagcaagagccggtgttctggaaactactttcaaagtagaaacagaaacagacttattcggtgagcaggcagttctttgtggtggtgttacagcattaatgaaagctggatttgaaactctggttgaagctggatatgctccggaaaatgcttactttgaatgtatccatgaaatgaagctgattgtagacttaatctacgaaagcggattccagggaatgcgttactctatctctaacacagcagaatatggtgattacatcacaggacctaagattgttacagatgaaacaaagaaagcaatgaagaaaatcctgtccgacattcaggacggtacatttgcaaaagattggatctcagaaaaccagacaggttgcatgcatttcggcgctatgagaagaagagaagcagagcatcagttagaagcagttggtgaagaacttcgtaaactgtacagctggaatggtacagacaaattgatcaataactaattttaatttgagtatcagataaaaaaagaaaaggcgacggacaaatgttccgtcgctttttagattttaagaatgtacagggagtttatttaaggcaagcccctgtttagtattgtaaaattcaataaattcccgaacagccgtggtttgctgtaaattatccagataagcaaaaccaatatttctgcggtgaattggaaaaggaaggggaatttctacaagctctccttctgcgagttctttttcaacaaattggcgaatgacgcaggcaacccctaaactgatttttgaaaattcgattaataaatccatagtagaaacttcaagaaggttattggtttcaatacgatgagcagcaagataatcatcgatatactggcgggtcatgttttctttatcaagcagcattaaagtggcattgcggaaaatgtcgtctctatgattggtgcgaagagaaagattgtttaaataagttttggtgcttacaaaaatatcttcgatttcaccaagactgtcaaaatgtacatgatgaggacgttccggttctccaattaaaccaacatcaattttattttcttttaagagttgcagagtatgattggttgattgacattcaatggtaatctttatatgtggatgtgttttaataaattcctgaagataaggcagaagcataaatttacataaagttgtactgactccaatatgtaaatgaccaatgcccagttcgttgatttttttaatacgggattcccctgtctggagcgaaaaaaacgctttttgaacgtaggtgtaaagaatttccccttcttccgtgagttgaacccctcgggaatttctggaaaataatgtaacgtctaaactctgttctaatttacggattgatttactgattgcaggctggctgataaaaagttgttctgcagcttttgaaatatttccggtattggctacggtgtagaaaacacggtataaggataagttttgttccatcttagaatctccatttttctttatgaatataagttatatctgatatgttttatatgtatttctattatatcaaaatttgtgctagaatatcaatagataaaagcagacaaaggtctgctaccataaaataaatttttagtgtatttttagggaggaatatccatgggaatgacaatgacacaaaagattcttgcagcagcagcagggcttgaaaaagtagaagcaggtcagctgattgaagcaaatcttgatttagtactgggtaatgatattacatctcctgttgcaattcatgagatggataaaatgacaaagaaaaatgtatttgataaagataaaatcgctctggttatggaccattttatcccaaataaagacatcaaatccgcagaacactgtaaatgtgtacgtgaatttgcctgtaagcatgatatcacaaattattttgatgttggagaaatgggaattgaacacgctctgcttccggaaaaaggattaacagttgcaggtgatgttatcatcggtgcagactctcatacttgtacttatggtgcacttggtgcattttctacaggtgtaggaagtacagatatggctgccggaatggcaaccggtaaggcttggtttaaagttccatctgcaattaaattcaatattgttggaaaaccggcaaaatgggtgagtggaaaagatgttatcttacacatcattggaatgattggtgtggatggcgcactttataaatctatggaatttgttggagaaggaatcaaaaacttaagtatggatgaccgtttcacaattgcaaatatggcaattgaagcaggtggaaagaacggaattttccctgtagatgaactgacagaacaatatatgaaagaacattccaaacgtccatataaggtatatgaagcagatgaagatgctgtttatgatgaagaatatacaattgatttgagtgaattaaaaccgaccatttctttcccgcatcttccggaaaatacaagaacaattgatgaaattacagaagatgtagtaatcgaccagtctgtaattggttcttgcacaaacggaagaattgatgacttacgttgtgcagcagaaatcttaaaaggacgtaaagtgaaaaagggagtccgttgtattgtaattccggcaacacagagtatttatcttcaggcaatggaagaaggattattaaagatctttattgaagcaggtgcagttgtaagtacaccgacctgtggtccatgtctgggtggatatatgggaattttagcagctggagaacgttgtatttctactaccaaccgtaactttgtaggtcgtatgggacatgtagattcagaagtttatctggcaagtccggcagtcgctgctgcaagtgctgtaactggtaaaatttctgtaccggaagaattaggtttatagtaggaggaaaagacgatgaaagcaaacggaacagtatttaaatatggagacaatgtggataccgatgttatcattccggcaagatacttaaactcttctgaccctgcagaacttgcacagcattgcatggaagatattgataaagactttgtaaacaatgtgcataaaggagatatcattgtagcagataaaaattttggatgtggctcttcaagagaacatgcaccaattgcaattaaagcggccggtgtcagctgtgtaattgcagaaacttttgcacgtattttctaccgtaatgcaattaatattggattaccaatcattgagtgtccggaagcagcgaaaaatattgaagcaggcgatgaagtagaagtggattttgacagcggtattattacaaataaaacaaaaggacaggcttttaagggacaggcttttccagagtttatgcagaagattatcaaagcagaaggtttaattaattatattaatgcaaataattaatatcaacgaaaataattaataaaatgaaatgcaagtggaattgaaatgttctgcttgcatttttttgtgacacataatccggagcttgcaaaacaaatttgtacgaggaccattaatcttgcagagattaataaaagataagaaaaatatataatataataggtagaaagaagtacaaaaaacttgaaaaatcgggtagagtgttcctgcccgattatcaaaaaaaggaagtttcttccttaaaattacttgacattttgatttggtaatgctattttaattatattaagcacagagtaatctgtaaacagcaaaatgcagagataaggattagtagaaatttttacggatttcagagagctgttggttggtgaaaaacagtagatgtaatattttgaactgcccttggagcagctgcccgaacttttactaataaagcaaggcgaggtaagatagtaggcgtagacggaatccctaccgttatcagcagggaaagatataagatggtttcatcagtatcttttgagagtatgaatttgattcatgaagtagagtggtaccgcgcaggacgttagtctttcgtctctattacaagtatattgtaagagatgagagactttttttgtttcagaaaaaagtggtaagttctaggaaaagaattatcaaaaagaagctctaaagtgatgtgccaaaatgattaggaggatttaagttatgaaaaacagcagtaagtacaaaagacagtattttttaccaccagtgaaatgtatggactggaccgaaaaagatcatgtagaaaaagcaccaatttggtgtagtgtagatttacgagatggaaatcaggcacttgtaattcctatgaatctggaacagaaagtagagttttttaaactgttagttgaaattggatttaaagaaattgaagttggttttccggctgcgtctgaaacagagtacacatttttaagaaaattgattgaagaagatttgattccggatgatgttacgattcaggttctgactcaggcaagagaacatattatcaagaaaacatttgaagcggtaaaaggtgcaaaaaatgtaattgtacatgtatataattctacttctttgtctcagagagaacaggttttccataaatccaaagaagaaattttaaagattgcagtagaaggtgcaaaattattaaaacagttgacagaagaagctggagcagattatcgttttgaatacagcccagaaagctttactggaacagaaccagaatatgcattggaagtctgcaatgcagtactggatatctggcagccaactgcagatagaaaagcaattatcaatctgccggttacagtagaacattctatgccgcatgtgtatgcaagtcaggtagaatatatgtgcaagaacttaaaatacagagaaaatgtagtcgtttctctccatccacacaatgatcgtggttgtggtgtagcagatgctgaaatgggtattttagctggagcagaccgtgtggaaggaaccttatttggaaatggagaaagaacaggtaatgttgatatcgtaacacttgctttaaatatgtatgcgcagggcgtagagccggagcttgattttacagatatctcttctatttgtaaaaaatatgaatcctttacgggaatgacaattaacgagagaagtccatatagcggtgcattagtatttgctgcattttccggttctcatcaagatgcaattgcaaaaggtatgcattggttggatgaaaagaaaccggaacactggacggtaccatatcttccaattgacccgaaagatgttgggcgtaattacgatgcagatgttatccgtattaacagtcagtctggtaaaggtggtgtcggatatattctggaaactaaatttggactgaatctgccacctaagatgcgtgaagcaatggggtatacagcaaaagcagtatcggatcatacacataaagagctgatgccagaagagatttttgaattatttaaacggacctttgaaaatgtagtaagcccgctgtccttaaatggagtacatttccagcaggtaaatggaggaattacaacacaggtaacttctatttttaatggaaaagagattacaacagaggcagaaggaaacggacgtttaaatgcggtaagtaatgcgttgaagaaagcatataattttgagtatgatttagtaacttatcaggagcatgcattagagcagagttccagttcaaaagcgattgcttatgtaggaattcgtaagccagatggtacactttcctggggcgcaggggtggatgtagacatcataagggcctctatagacgcattggtaactgcaatcaataatcgataaaagcttaaatttttatatcaaaatgttctcgagcaaacataatacctaaagacttggtaatgttaaattaagaaaatctcaatagcaaagcaggtatataagaaaaaatcattcttttgtacctgctttttttatgaaaaaccacgaaaaatcagagtaaatttggatgaaaaattgtccgagttttcaaataaatttatgtaatatagacaaaagacttttgaacttattgacttctatcctttaactatcatataattcaaaataactgattaggtgaaagtatagagatagagaaaatagtttaagagaacaaagggaaaaggtatgaacaagattcaaaaaattgaatcgaggcttcttagagtaataaaaagatgcttgagaaactggaaaagaaagcaaaagaaaaaacaggttcgaaaaagcagaaaaagggttagaactagaagagagattcaaacgagaaagacgtcaggaaaggcagcacagagaaaaacggggaaaacaggtagtcagcacagacagtcacaggcaagacgaaaaaatgaaagaaaaattcaggaaaaaagacgacagtttattttgaaaactgctgcgtttgcggcggtgggagtattatctgcggcaggagtatttctggttaaaaaacttactatacaggctgaggcttcttcagcaaaatcggtagagactgtagtagaaaaagcacaggaagaaaataccagacaatacatgtatgggattgaatccattatttccggtgtctgtatcagtcaggacacggatagtgaggtaaataaattaggaacgtcttgtgaagcagttttagttggtcagcgtgttgggaaaaatcagcaggaatcgaatcttgattttagtaaagcggcagctgataccgtagaaaaactggagaatcattcgttagatgtggaacagtatttaaaagtgacagacagagattatgaaactttgttaaagattgtagaagcagaagcaggtggagaagatacagaaggaaaaatcatggtggcgaatgttattttcaatcgtttgcagagtccgatttttccagatagcatttatgatattgtgtggcagaataccgacggaactgctcagttttcaccgacagcagatggaagaattaataccgttactgtttcagaagataccagagaagcagtcaatcgtgcaattgatggagaagattattcacagggagcattgttttttatgcaggaagaatattcggattcagacaatgtaagttggtttaaaagggatttggaatttttatttaaacatggtgttcatgccttttatacatatccggaaaagacattgaaagaattagaagcgaatgcttcttcaaaaaagacagaagaagaaaaagaagaaccagatgattcttcaacgaagacagaaacttcaacggaaacaaaaatttcgcctagaaagaaagagaaatcttccaaaaaaggaaagacatctacagatgagacatcgaaaaagacaagcaaatccgatgcaatttaaatgtaagtaagctacaagatataccaattgaaaaaatagaagtgtatcttgacttaataaataaggaaaggacaaaaagacaatggaaattttgtacaaaagcacaaggggaacaggagaatgtgtaacagcttctcaggcaattttaaaaggattatcagatgatggtggattatttgttcctacacagattccggttttggatattcctgtagagaaacttgcatccatgacttatcaggaaatcgcttatgaggttatgagtcgtttccttacagattttacagaagacgaattaaaagcatgtattgaaagagcttatgattctaaatttgatacaaaggaaattgcaccggtgaaaaaggcagatggtgcttattatctggaacttttccatggggcaacgattgcatttaaagacatggcactttctattctgccacatcttcttactacttctgcaaagaaaaataatgtaaaaaatgaaattgtaattctgaccgcaacttctggagataccggaaaagctgctatggctggctttgctgatgttccgggaacgaaaatcattgtattttatccgaaaaatggtgtcagcccggttcaggaaaaacagatggtaacacaaaaaggaaataatacttacgttgttggaatcacaggaaactttgacgatgctcagacaggcgttaagaaaatgtttaatgataagaatatggcagaagagctttcaaatgcaggatatcagttctcatcagcgaactctattaatattggacgtcttgttccacagattgtgtattacgtatatgcttatgcaaccttatataaaaatggagaaataaaagcaggtgaaaagattaatgtcactgttccaactggaaactttggaaatattcttgctgcattctatgcaaagaatatgggacttccgattgaaaaattaatctgtgcatccaatgaaaacaaagtattatatgatttcttcagcacaggaagttacgacagaaacagagacttcatcttaacaacttctccatctatggatattttaatttccagtaacttagaacgtctgatttatcgtattgctggtgaagatgcagataaaacaagagaaatgatgaatgagttatccaaagatggaaaatatgaaatcactgccgagatgcgtgcgcagttaaaagatttctatggaaattatgcaacagaagaagaaactgccaaaattattaaaaaactgtatgaagatacgggatatgtcattgatacgcatacagcagttgcagcctgcgtttatgaaaaatataaaacagctacaaaagatgatacaaagacagtcattgcttctactgcaagtccatttaaatttacacgtagtgtaatggatgcaattgatcataaatatgatgcaatggaggattttgaactgattgataagttatctgaaattgcaaatgtgaaagttccaaatgcaattgaagaaatccgtactgctccggtactgcatgatacagtggtagaggtagcagagatgccggcaattgtaaaaaaattgttgaacgcttaaggtttaatgagagaaaatgttgactttttagttattacatgagataatacttgagaatttagaaaaactttcataaaaaaccaatttttattcagtaatttttgttgaaaaacttcatatactagagtataatgaaatcacgaagtaatcctgggttgtgcgatgctcctattatttttgaacctacatttactttaaacgggattcctatattgccagttggatgtcaggccgtcattgcgcagcggaaggcagaagaatggttgcggtcacccacctagcaacagctaggagtcagaagataggaaacggcatctcgggattacttaattttatgtttgaaattagggagaaaacagatggcaatcacaaaacagagtttcggaaagagtacggatggaacagaagtttttctttatgagattacaaatacatccggagcaacgatgaaggtaacagattttggagcaattttggtaagtcttatggtaccggatgaaaatcataaattaagagatgttgttttaggctatgatactgtagaaggatattatgaaaatccgcctcattttggttctccaatcggaagaaatggtaaccgtattggaaatgcttcttttacaattgatggtgtgacttatcagttggaaaaaaatgataatggaaaaaataatttacatagtggcccgaatttctatcgtaccagagtgtgggatgttgcagaaatagatgcagagaaaaacagtattacattttctattaagagcccacatttagaccagggatttccgggaaactttactgcctttgtttcttatactttgacggaaaagaacgaattggtattggattataaaggaattgcagataaagatacgattgtaaatatgaccaatcattcttattttaacctggcaggacatgatgcaggtgcagaaagtgtaatgaatcatcttgttcagattcatgcagaagaatacacaccaaccgataaactgttaattccgacaggtgaaattgcgccggtagcaggaacaccaatggattttacaacaccgaagaagattggacaggatgtagatgcagattttgaacagcttattatggcaggtggatatgaccataattatgctttaacccgtaaaaaaggtgaaatgagagaagccgctgtagtttggtgtgaggaatctggtattcagatgaaagtttatacagaccttccgggaatgcagttttatatcggtaattttattgaacaggaaaatgggaaagctggatgcgtttatggaaagagaagtggtttctgtatggaaacgcagtattatccaaatgcatgtaatgaagaaaaatttgaaagctctttattaaaagccggagaagaatatcatactactacagtttacgcattttctacgaaataaaaaataaaaagtttgtatgcccgtcaaattgtattttatcttaaaatggaatactgtttggcgggcttttgtaccaaaatgcagatatttgaaaaagaatatctgcattttttttctcatatacttaagctgaaattttatttgaccggagcttagggatgaaccgaaactatctgattatctgcttatgctgtgttcttgctctgaatggattaggaatacaagaactgaaaaaacaaagaatagagttaaaaccagaaacagaagaactgataaaaagggaaaatgaaaaaaaagtgatacaaagaaactctaaagaaaaaatggaagaaacgtcggaaagcaaatcaaaatccgaagaaaaaagaacaaatgcagaaaaatcagaaacaaaagaagcaaatcaggagttagaaatttcggttgcaattatgacaggacagtatacatcttattttcatgaacggatagagttagagtttgaatcagattatcaggaagaaaacagtggaaaactttatttagcaaacgaaaaactggttttagaaaaagaagaggaattgtcagaagcgggaaggctggtgttatcgcctgttgatcggactaaagaaaatagaatcagagtattgtcggtagaacgaggacaaggaacaccgtcttatgggggaacgcttatcattggaaaagaaaaagatggctggtatgtggtaaacaggctaccgttagaagaatacctttatggtgtagtaccaagcgaaatgccttctgattatgaaaaagaagctctaaaagcgcaggcagtctgtgcaaggacttatgcctggatgcagatgcagaaaaatcaggatccggttgggattggtatcgctcaggtagatgacagtgtttcttatcaggtttatcaaaattcaggagagtctgagacagcaaaagaagcagtagatgagacaaagggagaaattttaataaaagacggacagccgattactgcttactatttttctacttctcatggaaagacgagtacaaacgaagtttgggaagcatctgctccggccagttatttaaaaagtgtagaatgtaaattcgatgcggatgtgccgtggtatcagtggaaagtatacttttcaagtgaaagactgcttgaacaggcaaaaaacaaactttcagacgcatcagtgcttgaaaaaatggaaattgagaaaacaggagaagcagatgctgttttaaaattaaaaatagagacggatataggtgtcattcaacttgaaaatgaatatgagatacgtgaatttttaagtccacagaatcttgaaatcgtacgccaagatgaatcaacagtaaaaggtggcaaattgcttccaagtgcctattttaccttggaagcacagatagatgaaaatggaaaaccgcaaggttatatgattcatggaggaggatatgggcacggagtgggaatgagtcagaatggggcaaatcaaatggcaaagcttggaaataattatcaagagattttgaattatttttatcaagaggtagagattgccccaattagtggggtgtgatataatgagcgttagccggctaaagcaggtaaagagaaaaatatagtttaaaccgagtcaagcggcaaaattgattgcgagtatctgcttgcgaatagttgcttaatagtaatagataataaaggaaaacaggaaaaaacattgagacaaggattttaaataaatgagaataatcaaaaaaataattcgtgatatctgggggttttcaagaagtatcagtgaaaagcatgtaccggcttatgctgcgcaggcagcttattttattattttatcatttattccgtttatattgcttttaatgacttccataagatatactcagttgaatcgcgaagaagtggttggagcaattatgcaggtgattccggataacctgcatgagtttatacagggaattgtagatgaagtatataataaatcggtcagcattgtgccggtgtcagcagtgatggcgatctggtcatctggaaaaggtgtgcaggccttaacaaatgggtttaattgtatttattctgtctatgagacacgaaattatattttaaccagaattcgttctgctgcctatacgttattgtttgtgattggaattattctgacccttactttacaggtgtttggaaatacactgcaaagagaattaagacgacattttccgtttttaaataaattggtttcgatgattatcagcatgagattagtgattacacttgcaactttgtgcggagtgtttttgatcctatataaatttgttccaaatagaaaggcaacatttcgtagtcagtttccgggtgctgtattttcatccgtgtgctgggttgcattttcgatgggattttctttgtattttgaattttttaataaaacatcgaatatgtatggaagcatgacaaccattattctgattcttttgtggatgtatatctgtatgaatattgtaatgataggtgcttcaattaatcattattttgaggaacgttttcgttggatgcatcaggttgcaacagatacaatcaaacgagagtatcagcagtttgtacagcatgcagaggaatttgcgggagaaaagcgccaggaatggacaggagacgaaaaaaagagtaaaaaagaaaagaaatagcagagagtatttcttgacagaaaacagggaaatgactatcattataagttggtgtgtagcagatgatattaggtggggaaaataattaggatacttaattaggttatctggcgagttagagaaaggttttagataaattatgaaactttatgtaatacgtcatggagaaacaacatggaatgtagaaagaaaacttcagggagcatcggatacagagttaaataaaaatggaattgcgcttgctataaaaacaggaaaagcgatgaaagagattccgtttgatttatgttttacaagtccgttaaaaagagcgagacatacagcacagctggtactgggagatagaaaagacgtgccggtgattgaggatgtacgtcttcgtgagatttcatttggggagtgggagggaaaagactccagattattgccggcagaaatgctcgataatttttttcatcataccgaagcatatcagcctcccaaaaatgcggaatcattagaatccatttgtaaaagaacacaggaattttatgaagaattgattcaaaaagaggaacttcaggataaaacaattttaattgcatcccatggatgtgcagtaagagctctgcttcaaaatgtatatgaaaatccatctattgaaaatttctggagaggttgtgtacctccaaattgtagtgttaatatcatagaagtgaaaaataagatttcaaaattaatagaagaagataaaatattttgatcgaatcaagtagcaaagaggattgtaaatatccgcttgaattacaagaaagaaaaggagaaaccaatgaaaacatcagatttttattatgatttaccggaagaattaattgcgcaggacccgcttgaagatcgttcttcttccagattaatgtgtttggataaaaaaagtggtgagttgaagcatacaaattttaaacatattattgattatttaaataagggagactgtctggttatcaatgataccaaagttattccggcaagactttatggaagcaagattggaacaaatgccggaattgaaatcctgcttttaaaaagaaaagatggaaatgtatgggaaacattggtaaaaccaggaaagaaagcaaaaccaggaacaaaaatcagttttggagacggtttattaattggagaagttattgatattgtagaagagggaaaccgcctgattcgttttagttatgaggggatctttgaagaaattcttgacaaacttggagaaatgccgcttcctccatatattactcataggcttcaggataagggacgttatcagactgtctatgcaaaacatgagggaagtgcagcagcaccaacagcagggcttcattttacaaaggaattattagagcagattaaagaaaaaggggtaaatattgcacatgttacccttcatgtcggacttggaacatttcgtccggtaaaagtagatgatgtagaaaaacatcacatgcattctgaattttatgtagtagaagaagaccaggcaaaattaattaatgatacaaaaaaagctggtaaaaaagtaattgcggttggaacaacaagttgtcgtacattggagtctgcaacagatgaaaatggaatccttcaggcaaaaagcggatggacagagatttttatttatccgggatatcaatttaaaatgattgatgaactgattacaaatttccatcttccggaatctaccttactgatgctggtttctgcactggcagggaaagaaaatattatgcatgcttatgaagaagcggtaaaggaaaaatatcgtttcttttcctttggagatgccatgtatattcatgattaaattaagatttgatagaaaaagagatttataaaaaagatgttctgttcactaagaaacgtggcagaacatctttttatttttgacttgattaaaacaaaaaagaaatcgtttatttagcggagcaaatcacgatagaatcccggataagagatattaacacaatctgcattggtaatttctgtttcaccgtctgcaaccagtccggcaactgcaaaggacatggcaatacggtggtcgagatgactgtctaaaacagcaccatgaagtgattttcctccacggataatcattccatcctctgtgccggtaatatcacatcccatttcgcttaaatgatgaacgataatttcaagacggttggattcttttacttttaattcttccgcatttcggataattgtttctccatttgcgcaggcagccataactgcaataactgggagttcatcaattaaagttggaatcagatctccttcaataacggttccatttaattcgctgtgttttacaaggatgtctgcgactggttcaccacattgcgttcttgtgttaagcaattctaagtttgctcccatttgtttgcagacacgtaaaattccatcacgagttggattgattcctacatttttgattaaaagctcagaacctggaattaaaagtcccgctgcaataaagaaagcagcagaagaaatgtctcccggaacttctactttttgagcggttaagactggttccggttcaattgttgcagttgtaccgcaggtttgaacgaaagcaccaaaagaggaaagcatcagctcggaatgattacgggataaaaatggttcggtaacactggtttttccatccgcataaagccctgcaaaaagcacacaggattttacctgggcagaagcaaccggagactggtaggaaattccctttaacggcgcacctttgatatgaagtggtgcacatccattgttatgaacactggtaatatcagcacccatcatagagagtggtgtcataatacgtttcattggacgtttttgaatcgaagcatcaccggtaaggtcgcaggaaaagttttgtccggctaaaataccggaaattaatcttgtcgttgtaccactgtttccggcatctaaaatttcttttggagcacttaaaccgtgcagtccttttccatgaaccagaatttcattttctgtttcttcaatttcaatccccattttttgaaaacaggaaatggtagagaggcagtcagcaccttttaaaaagtttgtaatcgaagtagtaccattggcaagagcaccaagcataatgcctctgtgggagatggatttatctccaggtacggtaatttctccttttagaggatgggatttatgaaataacatattgtaaactcctaacgctcataaataatatagtttcgttttctaagctgctcagaagcggctttcagggcttcttcatcgtagaaatcaatttttaaaacaccttcatcaaattcacgattatgaagaatgccaatatttttaatgctgattccgttcatggacaaaatggttgcaattgtggcaattgcaccggtttcatctacgatatcgcagtacagtgcgaattcttttttgattggaccacttgaagtgttatcaaaagagtttcgatagtctcttgaagaagaaaacatctgataaagtccattggaatctttctggtcgatcaggtattttgcctgtacaattaagcggataaattcatctaatactttggaaatgttatcagggttttccagacaaatctgctgccacatataaggggaggaagaagcaattctggtaatgtccttaaatcctccggctgcaatacttttcatgtgttcatctgaagaatccagtttttgaaccagattgacaagagaagaagcaacaacatgaggcaagtgactgattgccgcagtaatatagtcatgttcctgagcagtaagaatcataggaagtgctccaatcgagcttaccagttcgctgtaccggctgattttatccagactggcttcctctgacggtgttaaaatataataagcattttcaattaaatggtcggaagaataagcgtaacctgttttttcacttcctgccatcggatgtccgccgataaaatttgcggccatggagagtttcgtgatttctttatgaatttctcctttgacactgccgacatctgttaaaatacagcctggacggattttcgttttcagccattttaaacattcaatattgtagtctactgtggcgcagagaaagatataatcacagagcgaaaatttgctgtccatttcttcgcaggcaatgtcaacaatgccttcaaagacagcatcgtctaaagtttcccgtgttcgattgtatgcgataatctgataatctgggtggaattttttgatggctttcgcaatagaaccaccgattaacccaagaccaataaaaccaattgttgtcgtttccatgaaaatctccttcttttttcggtaatcagacaagactgatgcagtgtcgtcaaaaatgaatcaaatacggcacaagtctgtcaaacataactattttatgacatcttgaaagaaaagtcaacggtttgacgctttaaagcgctacgctgacattttgcataatgaaaaagaaagaaaatgaaaaaataccttgtctaaattgaataaaatacttgaaaaattgatttttttttagtaaaatatatacatattaaattttaggaggtattacatatggacgtttttagaagtgacagaattagaaatgtggtcctgcttggtcacggcggttccggtaaaacaagtctggtcgaggcaatggcttatttatcaggaataacaaaccgtttaggtaaagttacagatggtaacacagtcagtgattatgataaagaggaaatcaaaagaaaattctcgatcacaacttcagtagtgccaatcgaatggggaaaagtaaaaattaatgtgctggatacaccgggctatttcgacttcgtgggggaagtagaagaagcagtggcagcagcagatgcagcaattattgttgtttccggaaaagcaggggttcaggtcggaacacaaaaagcatgggagatgtgcgaaaaatataatctgcctcgtatgttttttgtaacagagatggatttagaccatgtcagctatcgtaaagtagtagaagacttaacggaactgtacggaaagaaaattgcaccgattcacatgccgattcgtgaaaatgaacagtttgttggttatgtaaacatcgtaaaacaggccggcagacgctacgttgaaagaggacagaaaaaagaatgtccgattccggattatctcgaagaatatctggaaaaataccatgatatcttaatggaatctgttgcagaaatcagtgaagaatttatggagcgttattttgcaggagaagaattttctgtagcagaagtttccgcagctctgaaaatgaatatttcagatggaagtattattccggtatgcatgggttctaccgtaaatgtacagggtgttgcaaacctgcttgatgatatctgcggttatttcccaagtccggctcagaaaacctgtgcaggaatgaatatgaaaacaaatgatatctatgaagcaaattatgattttgcaaaagcaaaatctgcttatgtatttaaaacaattgttgatccattcattggaaaatattctctgattaaagtctgctcaggtgttatcaaaggggaagatactctttataatccaacaaaagatgcagatgaaaaacctggaaaaatctatgtattacagggtggaaaaccaattgaagttccggaacttcatgccggtgatatcggtgcaattgcaaaattaaatacagtggcaacaggtgatactctttctacaagaacgactcctgttgtgtttggaaagacagagatttctgttccatatacctgcaaacgttataaaactgtgaataaaggcgatgaagataaagtatctcaggcactttccagaatgatgcaggaggatcagacactgcggattgaaaatgattctgcaaaccgtcagaccttgatgtatggtatcggagaacagcatcttgacattgtatgcagtaaattaaaagaacgttataaagtagatattgtgctttcaaaaccaaaagttccatttagagaaacaattcgtaaaaaagccgacgtagatgcaaaatataagaaacagtccggtggacatggacagtatggtcatgtaaaaatgacatttgaaccatctggtgatttagagactccttatgtatttgaacagaccgttgttggtggtgcagttccgaaaaactatttcccggcagtagaaaaaggaattcaggaatcagtcttaaaaggacctttagcttcttatccggttgtcggtgtgaaagcaactttatacgatggttcttatcatccggttgactcttctgaaatggcatttaaaacagccgcaattcaggcatttaagaaaggctttttggaagcttctccagtattgttagagccgattgtatctatgaaaatcaatgttccggacaaatataccggtgacgttatgggtgatttgaataaacgaagaggacgtgttcttggaatgaatccagatgcccagcataaaggctgtacaatcgtagaagcggatattccgatgctttcgatttacggatattcaacagacctgcgctctatgacaggaggaagcggagtgttctcttatgagtttgcccgttatgagcaggcaccgtctgatattcaggaacaggaaattaaagctcgtcaggaagaaggcgcagatgcttaaaataatttaagaaaacttaagaagatatctcgaaagagtggggctttcgggatatcttttttttcggttttgtgttacactgtaccgtaacacaaaaaaagaaaggaatttagatttatgaaaaagaaattattagcaggaattgctgttcttttgctggcatttttatattattatattgaactgcctgcaattaatatccatgaaagtggattctggtttttccttgtcgcagtaattggaattattgtggttgtttatgcaattcggaaaagactttatggaacaattcaattaaaacaaagcaaaggaatcaaagtaggtgttattttaatgcttggaatcattgcagtatatgcggtgggttctctgctttcttctccaattatcaatgcaaagaaatatcaaaatcttgtgacaccggaggaacgggattttacagaagatatccaggaaatcagttttaatcagattccgcttctggataaagattctgcagtattactgggaaatcgaaaaatgggaagtatggtagatatggtttctcagtttgaagtcagtgatttgtattctcaaattaattatcagggacagccgtatcgtgtcacaccactggtgtatgcaaatgcaattaaatggctgaccaatcaaaaagacggaattccggcttatattcggattgatatggcaacacagaatacggaactggtaaagctggaggatggaattaagtattcagagtcagagctgcttaatcggaatatttaccgacatcttcgttttcgttatccgacgtatatgtttgaccagttgagctttgaaattaatgatgatggagtaccatattggatttgtccggtaaagaaatttaatattggtttatttggcggacagactattggaaaagtggtgctttgtaatgcaattaccggtgagacagaagaatataaaataaaagactgtccgcagtgggtagaccgtgcttatccggcagacttattgattgacttatataactatcatggtacattgaagaatggattttttaatagtgtgctggggcagaaagggtgtttaaagacaaccgatggatataattatctggcacttgaagatgatgtatgggtttacaccggaattacatcagtaagtggagaccgttccaatgttggatttatattgatgaatcagcgtacaatggaaaccagatattattcctgtgccggagcagaggaatattctgctatggaatcggcagaaggacaggtacagaacttaaaatataccgcagcttttccattgttattaaatatttcaaacgagccgacttattttatggcactcaaggacggagccggtctggtgaaaaaatatgcgatggttaatattcagaaatatcaaaatgttgcaatcggtgataccatatcagagtgtgagaaagcttatgtcaaactgcttgcctctaatggaattacttcaacagatgaaaaaagtacaggaacaaatgaaatcagtggaaaaatcaagagaattggacaggcggtcattgatggaaattcccatttttatcttgcattggaagaaaacgatgaggtttatgatgtgccagtcgtggattatccggaaattgtgacttatgatgtgggagatgagattactctggaatatagtgaagattcaccggcaaatgtagttcttggaataaaataaagtggttttttggattcttacttgacaaatacaagggttctgggtagaataacaatagttaaagagagtagaaaatactctgaaacatgaaaaaaacattgaagaggaagagtacacatggttctttaatacagagagctgccggcaggtgaaaggcagtgagaagaaatgtggaactggccttggagttcctttgcagaacggaagaatttcttagtaagaaaaggcgggagttcccgttacagaatcaatgagtgcatctgtagatatagagatacagatgaattagagtggtaccacggaatgaatctaagcccctttcgtctctaaaagtttagtgacaaaaggggcttttttatttcatggtaaataatgtattctcagagtctttttatagttagtaaaggactttgaaagcgcataataacaattaggaggaaacaacaatggcagtaccttataatcataaggcaattgaacagaaatggagagaaaactgggaagcaaaaccggtaaacgtagatgacggtaaaaaaccgaaatattattgtctggatatgttcccatatccgtcaggaaatggacttcatgtaggacattggagaggatatgttatctctgatgtgtggagtcgttataaaatgatgcagggttattacctgattcatccaatgggctgggatgcattcggtcttccggctgaaaactatgcaatcaaaatgggagtacatccggcaaaatcaactgcacagaacattgcaaatatcaagagacagattaatgatatcgcagcaatttatgactgggatagagaagtaaatacaacagacccgaatttctacaaatggactcagtggatttttgtaaaaatgtttaaagaaggtcttgcttacgaaaaagaattcccgattaactggtgtccgtcttgtaaaacaggtcttgcaaatgaagaagtagtaaacggatgctgtgaacgatgtggagcgactgtaacaaagaaaaatcttcgtcagtggatgcttcgtatcacaaaatatgcagatcgtctgttatccgatttggataaattagactggccggaaaaagttaagaaaatgcagtctgactggattggaaaatcctatggtgcagaagttgacttcaaggttgatggaagagaagataacattacggtttatacaacgagaccggataccttacatggtgcaacctttatggtattagctccggaacataaactggctgcatctcttgcaacagaagaaacaaaagaagcagtagaaaaatatatttatgattcctctatgaaatcaaatgttgaccgtctgcaggataaagagaaaacaggtgtatttacaggaagttatgcaatcaacccattaaatggaaagaaagttccaatctggctttctgattatgtactggctgattatggtacaggtgcaattatgtgtgtaccggctcatgatgaccgtgactttgaatttgcaaagaaattcgatatcccgattattcaggttatcgcaaaagatggaaaagaaattgaaaacatgactgaggcttataccgatgcagttggaacaatgattaattccggtgaatggaatggcatggaatcttctgtattgaaaaaagaagcaccggctatgattgaaaaaatgggattcggaagaaaaacagtaaactacaaactgcgtgactgggtattctcccgtcagcgttactggggtgaaccaattccgattatccattgtcctcattgcggaaatgtaccggttccggaagaccagcttccattaactttaccggaagtagaatcttacgagccaacaggtacaggagaatctccacttgctgcaattgatgaatgggtaaatacaacttgtccggtttgtggtgcgcctgcaaaacgtgaaacgaatactatgcctcagtgggctggttcttcctggtatttcctgcgttatgtagataacaaaaacaacgaagaattagtttcaaaagaaaaagcagataaatatcttccggttgatatgtatatcggtggagtggaacatgcagtactgcatctgttatattctcgtttctatacaaaattcttatatgatatcggagtaattgactttgatgagccgttccacaaactgttcaatcagggtatgattacaggtaaaaatggtatcaagatgagtaaatcaaaaggaaatgtagtatctccggatgatttagtaagagattacggctgtgactccttaagactgtatgaactctttgtaggaccgccggaattagatgcagaatgggatgacagaggaattgatggcgtttaccgtttcttaaatcgtttctggaaactggctatggacagcaaagaagcaggagttgccgagacaaaagaaatgataaaactgcgccataaactggtatatgatatcacacagcgtctggaaagcttcagcttgaatactgttatctccggattcatggaatacaacaataagttaattgaacttgcaaagaaaacaggtggaatcgataaagaaacaatcgagacatttgtaaaactgcttgcaccatttgctccgcatattacagaagaattatgggcagaatacggtcacacagattctgtattccatacacagtggccgacagcagatgaagaggcaatgaaagatgacgaaattgaaattccggtacagattaacgggaaaacaaaagcaattatcagtatttcggcagaagcaaccaaagaagaagcaattgaagcaggaaaagctgcagttgcagataaactgacaggaaacattatcaaagagatttatgttccgaagaagattattaacattgtggcaaaataaaaataaataaaaatagaataagaacaaaaaggatatgatgcgtctggtgtcatatccttttttgcttttaagataatataaatggcattagctatgctgaataaaataaaaaaagaaagtatgttcgattttgctgatggttttacaattatataatatactatatgatagaaaagaaaaacattatattttatatagcttttattcttccactaattgaattcctgaaatatccggttcaataattaaggaataattggtatagtacacaacaaaccctggtttcgagccgtttggttttttgacatgttttttctgaatatagtcaatttcaacttttggagcagtccttccactggaataatatccggcaaggcgtccggcttcttcaaaggtgcgatccggcagttcttcgttgtttgattttacgataacatgagagcctgccattttttttgcatgaaaccaccagtcatttcctgttgcgaatttaaaggtcagttcttcattttgatagttattttttccgacataaatgtgataaccgtcactggaaatataatgcaaaggcttagatttggattgcattttctttttgttattcgaggtatgttttttgatataaccgtattcagtgagctcgtctttaatttgagagaggtcattttcctgtctggcaatatcaagtgcagcctgaatggattctaagtgaagaatttcagattcggtatcagcgatctgttcttcaagagcctgtgcggtacgttttaatttattataacgttcaaagtatttttttgcattttcctgaggggtcatagttgcatcaagtgggatagtaatttcctcattggtataatagtttaatgcctgaaatgacttacagccttcttcaaggttgtatccgtaagtattaatcagttcaccatatactttatatttatccatttttgtagtgtcacgcatctgtttgctttgtaaatcgaatttttttcgattacggtcaagtgcagtctggacaattcggcgcaaatcagcagacttttgtcggatacgggtaatctgatttttttgtgcataatataattctaacacttcagaaatcgtctggaattttttgacggtaaacccatcgtatttacacagtaaaaaagctgcatattctacaggttccccttcttcattataaacaatattcggagaaaagtctccatttgtaacatcttccatcatacgggcaaaggtatgataaagatgaactctggcttcttctgaaagagaagctgtcggttcacttccatcaatggagcttctagagcagatttcttcagcagcagcaggacttaaaccggtaagagaggtgtaaatcgcctttgcgacaggcattggcttttcacagacgatctgataaaattctttctcagtaattgtaagaggattttgtttttcctgtgtctgaggaataaaataatcgcgtcctggcagtacttcacgcacggaactcatgtttagagagacatgtttaatactgtctaaaatcatgcgttcttcatttaagaaaataatattactgtgttttcccatgatttcaacaacgagtgttttatggcataaatcgccaagttcatttaagtgctcgattttaagttcgatgacacgttcaagtcctggctgggtcactgctgtgatttttccgctaccaatatgttttctgagcagcatacaaaaatttggcgcagttaaaggacttggtttgtttttttcagtaaagtaaataaggggaagagaagcactggctgaaatcaaaagacgatactgagtacggttattttttatagtaagtaaaagttcgtccgcttccggctgtgcaattttattaattttaccaccgacaatggtgttatttaattcttttacgatgtttgcaattgtaattccgtcaaatgccatgatatgaactcctatctatagttagttgaacgcagataagcattcccccgcttcaagtgtgcggagcactaagcggcgggtgaggggggatgcttctgtcagtgggaattgaaagctcccactgacagatcgcgaagcgattgcgttcatgagcaagtagcgaagcggattgcgaatgtccgctttacttgttctttttattataatcgaaatacaaaaacaaagcaatgaaaaaaaggtttgactgtattatacgattgctttataataatttatgtatgtttatgccacaggcaaatataaaacaacagaaaagagtacgacatgattaagagcatgactgggttcggaagagctgagatgattgatgaagagaaaaaaattgcggtagagatgaaatccgtaaatcatcgatatctggatatcaatatgagaattccaaagaaactcagcagttttgagggtgcgatacgcggtgttttaaaacaatatatgcagcgtggtaaagtagacctttttattacttatgaggactacacacaaagcggtgtgacagtaaaatataatcgtgaaattgcacagcagtatctcgaatattccagacagatagaggaagaatttcaactgaaaaatgatatgaatgtttcaaatatcatgcggtttccggaagtacttacaatggaggaagaaaaggtagatgaagaagaactgtggacttctcttaaacaggttcttgtaaatgcggttcagccttttattaattcaaggatacaagaaggaaatcatttaagtaaagatattttagaaaaactggatggaatgtaccggaaagtagaactggtggaaaaacgttctcctgagattttaaaggaatatcgtgaaaaactggaaaacaagacaaaagaactgcttgcagatgcccagatagaagaaagccgaattgcggcagaagtgattttatttgcagataaaatttgtacggacgaagaaaccgtaagactaaaaagccatatcaatcacatgaaaaaggtactcacggaagaagaaggtgcaggaagaaaaatggattttattgcacaggaaatgaatcgtgaggcaaataccattctttcaaaagcaaatgacttggaaacttcaaatctggcaattgacttaaaaacagagattgagaaagtgagagagcagattcagaatattgaatagaggcaaaaaagatgtcgaagttaatcaacattggatttgggaataccgtaaatacagataaaattgtagcggttgtaagtccggatgccgcaccgataaaaagaatggtgcaggcagcaaaagaagaaggaatggcaattgatgcaacgcagggaagaaagacaaaagccgtgattataatagaaaatcatacattggtattgtcagctcttcagcctgagacaattgcaaaacgatttggtacattttttgaaacggaattgagaggggagcaagatggctaatcgaggaattttagttgttgtatctggattttccggcgcaggaaaaggcacattaatgaaacatttgctggagaagtatgataactatgcgctgtccatttcagcaacaacaagagcaccgcgagagggtgaagaacatggaagagagtacttcttccatacaaaacaggaatttgaagaactaattcttcaggatgcactgattgaatatgcacagtatgtggagaattactatggaactccaaaggcttatgtggaaaaacagttagaagccggaaaagatgtcattttagagattgaaattcagggtgcgttaaaagtaaaagagaaatttccggacaccttgttattgtttgtaactccaccgtctgctgaagaattaaaacgcagactgataaacagaggaacagaaacaaaagaagtaattgattcaagactcagacgtgcgtcagaagaagcaaagggaatgccgttatatgattatattttaatcaatgacgatttagaagaatgtgtggataccatgcatgaagtaattcagagtcagcacaataaatccagcaataatgttgcatttatagaaaaaataacaggcgaagtcgccgtatttgcgaaaggagaatgaatatgatacatccatcttacacagaactgatgcaggcaattaatgaaggtgtggacgtagaggatgaaccgattgtaacaagtcgttactctatcgttcttgcaacaagtaaaagagcaagacagttaatcgagggaaaagaggcaatggtttccacaagaggaaagaagccgctttctacagcagttgaggagttctataaaggacttgtaaaaattgtaccggatgagaatacagaagaagtagtagaagaaacaactgaagaagagtaaaagtcggggactgcacacaagttgcagtcctttctaccacttggagaaaattaaagtcaggattatgcgagactgaaaaaatagagatagaaacagggaggattatgagaaaagtattatttatttcccttgggtgtgacaaaaatctggcagattcagaagaaatgcttggaatgttagttactcatgggtatgagattacaaacgatgaaacagaagcaaatgttgcgattatcaatacctgcgcatttattcatgatgcaaaagaagaaagtattgcaaatattctggagatggcacgctataaagaggaaggtcagttaaaagttttattaataaccggatgtcttgcacagcgctataaagaagaaatcgttaatgaaattccggaagtggatgccgtgcttggcacgactagctttgacgacttattagaagcaatagaccaggcatttggcggagaacgttatctggaatttaaagatatttcttatacaccgcaggtggaaacaaagcgtatgattacaacaggcggtcattttgaatacttaaaaattgctgaaggttgtgataagcactgtacttactgtattattccgaaacttcgtggaaactaccgcagtgtgccaatggaaaaactgttaaatcaggcacgttatcttgcagaacagggtgtaaaagaactgattcttgtagcacaggagacgacggtttatggcgtggatttatatggagaaaaatcacttcataaattgttaaaagagttatgtaaaattcccggtattgcatggattcgtgtactttactgttatccggaagagatttatccggaactgattcaggtcatgaaagaagaaagcaaaatctgccattatctggatttgccgattcagcatgcaagtgatgccattttaaaacgaatgggaagacgcacaacaaaagcagaattaaaagaaattgttggaacgctgagaagagaaattccggatattgtgcttcgtacgacgttaattaccggatttcctggagagacaccggaaaatcatgaagaattaatggaatttattgatgagatggaatttgaccgccttggagtttttacttattccgcagaggaagatacaccggcagcatccatgccggaacaggtggatgaagaagtgaaaaaagacagacaggcagaactgatggaactgcagcaggatatttctttagataaaggaaatgaaaaaattggacgagacatgcttgtcatgatagaaggaaaagttgcagatgaaaatgcctatgttggacgtacttatggagatgctccaaatgtagatggttatatttttgtaaatacagatatggaactaatgtctggagacttatgtcaggttcatgtaaccggagcactcgaatatgatttgataggagaactgaaagatgaatacaccgaataaacttacaattgcccgtgtgattatgattccgttttttgttgcatttttgatgtatgatattgcaggagatgcaggaaaatggatcgcacttgttatttttattgctgcaagtattacagacaccttagatggctatattgccagaaaatatcatttggtaacgaattttggtaaatttatggatcctttggcggataaattattagtctgctctgcattaatctgctttactgctacaggtaaacttgcagcatggatcacgattattattattgcacgtgaatttattatcagtggttttcgtctggttgcagcagataacggaatcgttattgcagcaagttactggggaaaatttaaaacagtatctcagatgattatgattattttaatgattatggatatccaaaatggagcattccagactctgattacggtatttattgttattgcagttgcactgactttaatttcacttgcagattatattatgaaaaataaacaggttttaagcatgcaggattaaatttagaagttttataaaaagatggcatccattgttcttttctttaatggatgccatctttttttctaaattatttaacaaaatcaaggaagtcccctgcttcaattgcaaaaagcaataagcatgggtggggacttgcttgtatcaggaggggggcaagccccttctgataagctgcgtagcagctatttggttatgagcaagtagcgaaagcggattgcgaatatccgcttgactactgcatcatttttataagctgtaatatacgctcaattcgggcggtctcttcaggggttttattttgctttaaggcttctatgatgcagtccatttcttttgaggtaaaagaaagagttccggattttttttgagtgtttgataaggatgacaccaaaaaaggaagaagctcagacattcctttttgacttccctgattggcaattgaatttagcatctgtaattttaaagggtcaattccgtttacattgtcagatttcatccagtcttccggcatagtttgcacctcctatcttgtaaacttttcttgagacaattcaaaaatttgaatcattgccattgtatttaaaagggtatcaattttttcttttgcagggccgtggcagactttactgcacgccgataacatttcaattgggtctttgggagtaaaatcctgagtctgcatttctccttgaggttctaagaaaacatgaaaagtttcttgaagttctaaaaatttggcaaaaacagaagcaaactgctgaccgcttcttggaagataaggcatagcagcttttaaaagttcaatctggtcggaatgaattaattcatcagatggagtagattccataaacgcttcctccataagggaaacactttttttagtttatgaaaaaaaagcagagaatattccaacgaaacatcataaactaaagcaaagacaaaaaaaggagactgaaggatggaaaaatcagaaataaaaaccagattagtggaagagaataataccatttatgaaatagatttggactgtttaaaaagaaaagaacagagaaaaaaagagaaaaaagaagataaaaaacgttctcaaaagataagaaattaataaaacttcatacagaaaatgagctgccgcaaaaacggcagctttttaaaatagtagaatgaacagtaagaatcagcagaaattatttccaccgcatccgcataacagaagcagtaagatgataatacaattgcagtcatttccataaccattgtgttgtccgcaaccacatccattattgccatttccgcaacagcataaaattaaaagaatccagataatagagttgcagtcaccaaaacatcttccaagtccacatccgctgtttccggtgcaggaatcgtcgcatccgcatccacagtttgtagcagctaaatcactcatattgttcctccgtaaggattttgattacaatttcatcttatgtaggaaatgaaaattggtgcatgaaaaaattaaaaagaggcaaaggtttgaaaaatttgatagatatcaagaatgcccaatccccattcccgattgggataaatccgatcttcacttcgccgtgctccacgaattaaaagagcggtcagttccgcagtattaaaaattttaggaggcattcttttttgtgcccattcgactaaaagagcacaggcacctgcagtaagagcacaggcagcagaagttccggtaatcgttgtataggtgttttggagagatggagcagagacattgacaccaggtgcagttaagtctggttttatctcttcaagtctggtaaaacctctgcttgaatttaaaaacaggctgttgttgtaggcactataggcagatattgtaataacataaggagaagtggcaggctctgtgatagtggtatctgggtttggacgcaggaagataacatccggagaaagaaaaccactgattggaagccataagtggaaagaacctttattttgatttctggcatagactcgtattttccagatcccaggagtgggggctgaaaatcgcatgaaaataaactgctcacctgagacattttgaataacagaagaagaaagaaaaatctttgtatcttctagaataaaatccagtgtttcacgaaaattaacacgggaaggaatccgagaaatgatttcacctaaaggtgattcaaaaccaacttcatagatttcaggagaatctccccataattccagcgtaaaaccagaggaatttgccggaacagaaagttcaacagggatataatcctgtggcatgggtgcataagagaaaaaatgatgggcttttccggcttcatttccggcggcaatcacaggatagaagccccagtagttagaaagttcggtaaacattttagcgagataggaacgaccagagtgtgcaccttgatttgtgccgagaccaagacagaggacaagaggctttttttgttctcgggctaagagtgtgaaaaatcggattgccatcataatatcggtctcttgaaaaacaggttcattgctggtatggtaaaaaatttctcttaaatactgcttggctggttttaatttgaccaccgcaatctgggagagaggtgctgcgcctgaaaaatcctgttcagggatagaacttccacaagcaatcccggcaagtgctgttccatgaccaatctcatcattagaaggaacaacttcaaatgggttggaagaggagagtgcttgattgatgtcttcttcaaagtaaacgcttccataagaaaggtcaaatggaggttgtccggtttgaatgttctgatcccagagtgcaagaattcttgtacgcttatcacgggttaaaaaagcagaatgagtgtaatcaactcctgtatcaataaagccaacaattacatttcgtccttttaaatcaagagaaggctggttttgtaccgttaaaatgccggaagattccagactgacaaggttaagcaaagaataaagtttgggcaaggtggtatagcgcaactcatcggtttccagataatttattaaattttcggatggacgtcggctgtgaatcataaccagatggctgttaaaaaactgaattccatattcactaaaatcttgttcgatcccatcatagtaagggagaataaaatccagatattcatctgagaggataacatcacgtaaattttccatagacataaaatagaaaactccttttgtttcaagtgtttaatatatatgcataagttgggaacaaaagactttttagaggttatatcataatatagaattaagaaatcgggaaatggagtttgatatgctgacaggaaaagggattggtgtggcgatgcttgataccggaatttttccacatattgattttgcaggacgaattttggcatttcaggactttatttatgatagaaagactccttatgacgacaatggacatggaacacatgtagccggaatcctgggaggcagtggagccgcttttcaggggaagtataaaggagtagcatgtggatgtaatttaattgggattaaggtattagacagaaatggaaatggagaaaaagaaagcgtaatccggtcattagactggattcaaaaaaacagaaaccgctatcagatacgaatcataaatatttctgttgggacaacacagaaagaagaacataaggatttaattgatgcagtggaaagggcttgggatacagggttgattgtggtggcggcagcaggaaatatgggaccaggagaaggcagtattacagccccgggaagcagtcgaaaaattattacggtggggtcttcggatttacttgtaaaaaacaggggaattagcggaagaggaccgacaaatgactgtatcatcaaaccggatgttgtggctccgggaaatgctgttatttcatgtgcgaaccgcaatgacaatatgccttataccataaagagcggaacttccatgtctacccctgttgtttctggcgctattgctctgcttttagagagagaaccatggcttacaaattttgaaattaaaaaaagattaagaagaactgcgaaggatttgggatatccgcataacttgcaggggtggggactgtttgaagtgaaatcatttttaaatgaaaataatggttgacaaattctgtatcattgtatacaatgatacaagaagtttgatacagcatcgctttatcaagagaaaacacagattgaggagtgaagaaaatgattaacagaagtgtccgaatgaattatcatacaaacttactggaactagaggagcatatgtatccgttagtagatgtggagacaccgaatgtctttcataatctgtttccatatacagaaataccgaaaatagcgtttaatgaccgtattgtaccgcatcacatgccggatgatatctggattacagatactacatttcgtgatggacagcagtctcgcgcaccatacagtacagaacagattgttacaatttatgattatcttcataaattaggtggagaaaatggaaaaattcgtcagagtgaatttttcttatacagcaaaaaagacagagacgctgtttataagtgtctggagcgtggttataaattcccggaagttacaagctggattcgtgcaagcaaaaaagattttgaactggtaaaagatttaggattaaaagaaacaggaatcttagtcagttgttcggattatcatattttctataaaatgaaaatgaccagaaaacaggcaatggaacattatttaagtgtaattcgtgaatgtctggaaaccggaatcagcccaagatgtcatttagaggatattacaagagcagatatttatggatatgtcattccattttgtctggaactgaccaagttgatggatgagtattctattccgattaaggtgcgctgctgcgatacaatgggatatggggtaaactacccaggtgcagtaattccacgttcaattcctggaattatctatggtattatgacacatgccggatttccatcggaattaatcgagtttcatgggcataatgatttttataaagcagtcagcaattcaacaactgcatggctttacggagcaagcggtgtaaactgttctttatttggaattggagagcgtaccggaaatactcctcttgaggcaatggtatttgaatatgcacagttaaaaggttctttggatggaatggatacaactgtgattactgaacttgcagaatattatcagaaagaaattggttataaaatcccgccacagactccgtttgtaggaagtgcatttaatgttacccgtgcagggattcatgcagatggtctgttgaagaacgaagaaatttataatatttttgatacaaagaaatttttaaataaagcaccgcaggttgcagtatcaaatacctcgggtcttgcaggtatcgcacattggattaataatcactatcagctggaaaatgaaaaagcaatcgacaaaaacagtgaactggttgtaatgattaaagcgtgggtggacaaacagtatgaggatggacgagtaactgtactgaccgatgaagaattaattgcagtgattgaagaaagttgtaagagattaaatattgagctttaaaataaaaaatgtacttttagagtcgaataaagattctgaaagtagataaaacaaaaaaggagaaaagatggcaggaacagagaagtctttaagaggacaggtttttgataaaatacgttccgatattttgaatggaaaatataaaagaggggaagaactggttgaaagttcaattggaaaagaattgggaatcagccggacgccggtaagagaggcaattcgacagctggaactggagggattggtacagcttgttccgaataagggggcatttgtaaccggaatttccgaaaaggacgtaagagatatctatctgattcgtgcacgcttagaaggtcttgctgcaagaatggcagcaaagaacattacaccggagcttttagatgcgatggaagagacggttgtcttatcagaataccatgcgaaaaaagaacattatgaacaggtatgtgagatggacagtaaatttcataaacttttatataaagcatccggaagccggattttagaacatacattaacggattttcatcaatatgtgcagagagtccgaatggcatccattatgaaaaaaagacgtatggaaaagtcaaatgacgaacatgatgcaattttaacagcaattcgtgagcacgatgaggaaaaagcggaattagtggcaactcgtcatatttcaaatacagtagaaaatttaaaaaactatgatttagacagtgtattaagtaagggcgaataaacgttagggcttaaggaggataagacgatggaaaaaattaaaatgacaacaccacttgtagagatggacggagatgaaatgacaagaatcctctggaagatgataaaagaggaattacttgagccatatattgatttgaatacagagtattatgatttaggactggagtataggaataagacgaatgaccaggttacaatagatgctgcaaatgctactaaaaaatataaagtagcagtaaaatgtgcgacaattactccaaatgctgcacgtatgaaagaatatgatttaaaagagatgtataaaagtccgaatggaacgattcgttccatgctagatggaacggtatttcgagctccaattgtcgtaaaaggaattgaaccttgtgtaaaaaattggaaaaaaccaattacattggcaagacatgcttatggagatgtctataagaatacagagatggtgattcccggcccgggaaaggtagaactggtttatacaagtgaagatggaacagaggtaagagaactggttcataattttgcaggtgcaggtgttgcacagggaatgcataatttaaatgattccattgagagttttgcaaagagttgttttggttatgcactttcaaccaaacaggatttgtggttttctacaaaagatacaatttctaaaaaatatgaccatacattcaaagatatttttcaggaaatttatgaaaaagaatataaagaagcgtttgagaaagccggaattacgtacttttatactttaattgatgatgcggttgcacgtgttatgaaagcagaaggcggatttatctgggcctgcaagaactacgatggagatgttatgagtgacatggtatcttctgcatttgggtctttggcaatgatgacttctgtattggtttctccgaacggttattttgagtatgaagcagcacatggtaccgtacagcgtcattattataaatacttaaaaggagaagagacttctacaaactctgttgcaacaatttttgcatggagcggagcacttagaaaacgtggagaattagataaaaatgaagagctgcaggcatttgcagataagctggagaaagcaacaatagagacaattgaaagtggagagatgacaaaagatttggcattgattacatcaattgaaaatccgactgtattaaacagcaaagaatttatccttgcaatccgtaataatttagaaaaataaaaaatttagaatgaaaaagggaagagggcattatgccaactcttcccatttttcatataattcttcgagttctaaagtgatttctgctttttcattggataaagcaacacattttgcaacatcaacagccacttccggtttggacatttcttcatcaatttcgctgtctctcaattcaagtttttcaatttctgcttctgttttctttaaatcattttcgcgttttcgtttttgagcctgttcttctttttgctgtttccagtctgatttattagaagattctgtttgaacagcgatggtttcttcttgaatgtccggcgcataaattttagtcagttcttcgcgcttttccatataatagtcataatttccaatataattgaccagattatggttggttaaatctaaaattctggttgcagttttattgataaaataacggtcatgagaaacataaagtaccgttccggtatagttattaagcgcttcttccaagatttcttttgaaacgatatctaaatggttggtaggctcatcgagaattagaaaattggcctctgataacatcagtttagcaagagagacacgtccacgttctccgccgctcaaagagctgatttgcttaaatacatcatctccggtaaaaagaaaagcggcgagaagattccgaatttcagtattggtcagtttaggataatcatctgaaatttcttcgaagattgttttttccatatgcagaacgtgatgttcctggtcatagtaaccaatatgaactttgcttccaagagtaaaagtcccgctgtcagcaggaatcacgccatttaaaatttttaaaatagttgttttgccggttccattatttccaatgattgcaacgcgttctcctcttttgacagaaaaacttaaatcagaaaaaagtgggagatttggaaatgatttacttaagtcttttacatcgagaacatcatttccactggtaatttttggttcgagacggattttcatagaagcgtttaattcacttggtttttcaagaacttccattttatctaacatcttttcacggctctctgcacggcggatagatttttcacgattaaactgttttaattttgtgatgacttcttcttgatgcttgatttcctgctgttgattcatgtaagcctgataagcttcttttcgaagcattgctttcttttcactgtatgcagagtagtttccggaaaaagaagaaacttttccgttatctatttcaattactttagatacaattttatcaagaaagtaacggtcatgagagacaattaagacagctcctgcatagtttaaaagataagtctccagccaggagatagaatccatatccagatggttggtaggctcatcgagaagtacgatatcaggtttggataacagcagacgaccaagtgccactcgggttttctgacctccggagagagttgaaaccagtttggaaaaatcactttccgcaaagcccagaccctttaaaacaccggttaattcgcttttataagcgtatccgttttccaattcaaaattatgggttaagcgggaataagtatccataagccgttctaattcatcagccttagcgtatttcatctgtttttctatttcacgcatctgtagttccatatcaagaatatgctgttttacttgaagtaaagagtcataaattgttaaatctgtatctaaatcctgatgctgtgccagataaccaattcgttttcctttagcaagaatgacttctcctttatcagtgggaagctcctgcataataatgcgcagtaaggtagttttgcctgcaccgttaattccgaccattgcagctttttcatggtcttctatatgaaaagaggcattttggattaaagttacgcctccgaatgatttttctatattttgacatgcaagtatcataagttcctccttaaaaaattctacttatctgtaaaaaaaaacgccattgtatttattatatcgaaaaaaatgaattttacaacagataaatgcggcaattaagagaattgtatttgactttattttaacaattatatataataaaagtaaatttgttttgtattgaaagaacgaataatcaggcaaaaggagggtaaagtcgtggacgaaaaaagtatatcgaaggctgtaatcagaagacttcctcgttattatcgatacttgggtgaacttttagaagagggtgtggaacgaatttcttctaatgagcttagttccaagatgcatgttacagcatctcagattcgtcaggatttaaataatttcggaggattcggacaacagggatatggatataatgtaccttatctttatgccgaaataggaaaaatattaggtcttgaccgaacccatcatattattattattggtgcaggtaatttgggacaggcacttgcgaattatgtaaaatttgaaaaaagaggatttaaggttgtgggaatttttgacatcaatccggtgttgaaaggaatttccattcggggaaatgaaattcgtatgatggatgagcttccggagtttttaagagagaatgatgttcaaattgcaacgcttactctgccgaaagcttatgcggaagagactgcaaaccttcttgtggagaatggaattaaggcaatttggaatttcgcacatttggatttggcagttccggaagatgtcattgtggaaaatgtgcatctgtccgaaagtctgatgcgtctgtcttataatctgaatcggtataatacagaacataaaaaagaatgatagaagaactgctgcgaaaaaatatttcgtagcagttttttgatatttttaaaacaaaaattgggggtgactttatgagagaattcgtatccggaacacagatgaagcaattagatagatatacgatacaggaaataggaattccatcactggtgttaatggagcgtgccgcaagaagtgtgtatgatacaatgataaaagaaagacttccgcttaaaaaagtacttgttttatgcggaagtggcaacaatggagcagacggtgtggcgcttgcaagaatgctgcatctttcaaatatttcggttgatgtggaaattttaggaaacccatcgcattttacgacggagatgaaacagcaaattgagattgcaaaaaaatatcaggttgcgtttgtcaagaataaaagcctgtctgaatatactactatagtagatgccatctttggggttggattagaccgagaagtaggtggaggttacaaagaaaaaataaaagaaattaatcaggcagatgccaaagtagtggcagtggacattccatcagggattgattcggcgacaggaaaggtacttggatgtgccgtttgtgcagactggacggtcagttttgcttatgaaaagctgggaactgttttttatgaaggagcagagtatgcaggaaatgtaagagtggcagatattggaattgtaaaaatgcctgaaatttgttttccgatttcaacttatacgtttgaagaaaaagatttgaaagaaaaattatttcgcagagaaagcggaaataaaggaacgtttggaaaagtattactaatagccggaaatgagatgaccagtggagctgctcttttaagtgcctcttcggctctgcatacgggagttggaatggtaaaagtgcatactcgaaaagagaacagggcaattcttccggtacagcttccggaagctatgtattgcttttatggcaaaaaagagataaaatcagaagcgttggcagaaagtctggaatgggcagatgtagtagggattggtccgggtcttggaacaaacaaacaggcagaagcattgttagaatttgttttgaaatattctaaacgaccattggtgattgatgcagatggattaaatttattaaaaagtaaacttgatttgcttgaaaaatacgagtatcctgtaatcatgactccgcatctgggagagttttcacgtttaagtggactttcaattaaagactggaaacaacagccgatagaacttacaaatgaattggcacatcgttataatgtaactttggtttgcaaggatgcacgcaccgtaattgcagatggcggtcaaaatgtctatgtgaatacaacaggaaatagtgggatggcaactgcaggaagtggcgatgtgctgacgggaattttactcggattgctggctcaaggctatgctcctttggatgcagctgtaatgggagtatgtgttcatggtctggctggcgatgaagctgcaaaagaaaaagggaaatatgcaatggtggcaggagacctgattacttatacaggagatgtgcttaagaaaagaggataagagattatgaatagaccaagtagaatttatgcaacaatcgatttagatgccgttacatggaatttggaaaatatgaaaaaaaatataagtaaagatacaaagattattgcagtgttaaaagcggatgcctatggtcatggagctgttcctatcgcacagcatattgaatctttgtcttatatttggggaatcgcagttgcctgtgtggaagaagggatggaacttcgtgaggcaggaattaaaaaaccaattcttattttgggttatacttttgcagaagattatccgacgattatcgagcatgacatgagaccggcagtttttacatttgagatggcacagcatttatctgatgctgcggtaagaatgaatcaaaatgcaaaaatacatataaaagttgatacaggaatggggcgaattggctatcgggatatcaacgaggcagttcctgaaattttaaaaatttcaaaacttccgcacattgaagtcgaggggatctttacccattttgcaagagcagacgaagcagaaacaacaccggcttatgtgcaattagaaaagtttcggcagtttatttcaagactggaagaagaaggactttcaattccgatgaagcattgctctaatagtgctggaattatccgtatgaaagaggcaaatatggatgccgtccgtgctggaattattttatatggcttatatccatctgacgaagtggaaaaagaaccggttgctttaagaccggttatggagttgaaaacacatatttcttatgtgaaaacagttgaaaaaggaaccgcaatcagttatgggggaacatttataacagaaaaagaaacaaaagtggcaaccattccggttggttatgcagatggatactgtcgtggattatccaataaaggatatgtactgatacatggaaagagggcgccgattcttggaagagtctgtatggaccagtttatggtagacgtaacagagattcaggatgcaaaaattttagatgaagtcactctgcttggaagagatggaaaagagaaaattacattagaggaattaggtgacttaagtggaagatttaattatgagtttgcttgctgtatcagtaaaagagttccaagagtctatctggtaagccgttagaatcttctttgagatttatggcaaaaagccagtatttccatagaaaatataaaaaccatagaatacacacgaaagaattgggaaaaatgataaaaaggtgtttgaatgcagataagcattcccccgctttaagtgcgcgcagtactaagcggcggctgaggggggatgcttatgtcagtgggagttgaaaactctcactgacagattgcgaagcgactgcgttcatgagcaagtagcgaagcggattgcgaatgtccgctttactagaagcaggagtcttattgactgagatagaaaacacagaaaaaaatcggagagtgaaaacgtgtggtaattaaacgtggtgatattttttatgcagatttaaggcccgtggtgggaagtgaacagggtggtgtccgccctgtattgattatacaaaacgatgtgggaaataagcatagtccgactgtgatttgtgctgctattacatcaaaaatgaataaggcaaaactgccgacgcatattgagattgatgcttcttcctatgcgatagtaaaagattcggtaattttgctggagcagcttcgtacaatcgataaaagaagattaaaagacaaggtttgtcatttggatgcagagattttacagaaagtcaaccatgccctgtgtgtgagtctggagctgcctacatagtgaaaaaatcttgacgtgagaaaaggaaaatggtatcttattgtagaatagctctgtgaaaaaagggcaatctgagacaagaaagagggaatagagaaattttatggacgacgggagtagtcctttatggacaggaatcgttttgattttatttgttatcataaacggaattttgtatggatttggttccgccatacagaaggtaagtgaaagtgaaattgaaaaaaaggcacaggaaggtgatgaaaaatcacagtggcttttaagtgtgattgattcaccggcacgagtgattaatacaaccttaatatcgagtgttttttttgctgtattatccggttatgttggaattcacaaaattgtgccggcacttgaagatgtgctgagaaatattgatttttttgcttctatgtcaaagaaggtacaggctgttttgtgtgcggctttcgtattatttgttatggtggggatactagtggcaattggaatgatttcttttaagaaagtttccgtaaaagagcctatgaagtgggtttatcgaacagagaaaacagttaaactgcttattacattatttacaccacttacgttttttacgattaaactgtcaaatgggtgcgtccgattatttggaattgacccacataaatcagaagaagatgtgacagaagaagaaattatttcgattgtggatgatgcgcatgaacagggtgtgattgaagaaagtgaagcagaaatgattcaaaatatcatagagttttctgataaagaggcgcaggatattatgacacatcgaaagaacattaatgcgattgatgaaaaaacgccgttaaaagaggcattgacgcttatgttaaacggcagtaattcaagatatccggtttatcgggatgatattgatgatattattggaattttgcatttgaaagatgcaatgaaagagatgatgtttgagaatcatgccgaagaaacagttggaagaattccgaacctgattcgggatgcttcttacattccggaaactcgaagtattaatgatttatttaagcgcatgcaggcaaagaaacttcacatggcaatcgttgtagatgaatatggccaaacatccggtattgtaacaatggaagatatcttagaagaaattgtaggaaatattttagatgaatatgatgaagatgaccattttattattgagcagttagataatacatatcttatgaaaggtttaactccgcttgaagatgtagaagaaacactttcgattgatttacaggaagaagagtatgaaacattaaatggttatctgacctctcttttgggacacattccgaatatcgatgaagataaagaaattcgggcaaacggttatctgttcaccattcttgcggtggaaaataatacaattcaaagagtaagggtagaaaaactacctgaagaaaaaggagaagagaaatgtcaggacattcaaaattcgcaaacataaagcataagaaagaaaaaaatgatgccaaaaaaggtaaaatttttactgtaattggtcgtgaaattgtaatcgctgtaaaagagggtggtccagacccgaataacaacagtaaacttcgtgatgtaattgcaaaggcaaaagcaaataacatgccgaatgatacaatcgacagaggaattaaaaaagcagcaggcgacagtaacgcagataattacgaaagaattacttacgaaggatatggtccaagcggagttgcaattatcgtagaaactttaacagataataaaaaccgtacagcgggtaatgtaagaagtcatttcacaaaaggaagcggaagtattggaacaccgggatgtgtttctttcatgttcgatagaaaaggtcagattatcattgataaagaagaatgtgaaatggatgcagatgatttaatgatgattgcactggatgccggagctgaagatttctcagaagaagaggacagctttgaagtattgacagacccagatgaattcagtgcagtgcgtgaagcattagaaaaagaaggaatcccgatgatggaagcagaagttgccatgattcctcagacttatgtagagctgactgatgagcaggatatcaaaaacttacagagaacattagatttattggatgatgatgatgatgttcagtatgtatggcacaactgggatgaataattttatctaaaaagattacatgatactaaaataaaatgcgcataatacctccagaaatttaatttttggaggtatttttttatgtcggaaacagaaaaaaaacaaatatcagaaaaagaagaaactcaaaatgaacagataagagagatggggcagatactgcttgaggaaaacaaacagaattatcggattcatctgctaagtatcattggagaagtagaggggcatgaggtattgtctgcaaacagtaaaacgacaaagtatgaacatgtacttccaaaacttgctgaaatagagaatagcagcgaggtagatggagttttaattctacttaataccgtaggaggtgacgtggaggcgggtctggcaattgccgagatggttgcctctatgagcaaaccaagtgtttctctggttttaggaggtggtcattcaattggagttccgatggcagtttcagcagattattcatatattgttccttctgctactatgatgattcatccggtcagaagtaatggaatgtttatcggagtaatgcagtcttataaaaatattgagaaaattcaggaacgcattacggaatttgtggcatcccattctaatatgggaaaaaatcgaatggaagaactgatgctggataccacacagctggtaaaagatgtcggaacaatgctggatgggaaagaagcagtaaaagagggattgattgatgaagttggagggatttcgcaggcattttacaagttatatgagctgattgaaaaatcgttggagataaagtaagaaaaataaaaattatagagagttttacattgtgcgaaagtagattttatgataaaataaatgttcgataaaagaatgttcccatttgttcaaaaagaacagaatgggaaaatacataagatatgaggttgtttttatgtcatatatacaggcatttttattgggaattgtacagggaattactgaattttttccagtgagcagttccggacatttagtgattttagaaaatctttttggaatgaaaatacagccatcggtgttttttcatgtgattttacacgccggaacactggtggcggttatactggcatttaattctgatgtaaaaagactgatattggaattccttcgattggtctatgatatttattataatatcagaacaggaattcataatggatggaaacagagtggaagacgctatcgaaagctagttcccaataattacaggaagtttatgcttttattaattgtgtctagtgttccgacttttattattggaatgctgttagaagagtcagtaagagtagcgtcagtaaatttgcttgcaccgggaatcggactcttgattacgggagttttgttgtttattgcagatttctttccaacgggaaataaagtgccaaaagaagtcagttatctggttgcggttattataggtgtttttcagggatttgcagtgttgcctggaatttcacgtgcaggagtgacgattgtggcttgtctgttatgtggtttgaatcgaaaatttgcaatccgttattcgtttttgctgtctataccggctgtgattggcgcagtggtgcttgaaattgtaaagctcaatccaagtgaattctcagcaggaatggcaggaatgagtgtactgggcttcattgcagcagctgtgacagggtgcttttgtattaaaatgatgttaaaaattgtaaaaagaaagccatttcgtcgttttagtgtatattgtttctttatggcagttctggcaattatctgcagctttgctttataagaaaaggcagtgtaaaaagggagtaatgtagatggcagcatcgaaaaaagcaaatttaggtaaaacaaatttagaaaaaacgaatcgaaataaaacaagtaaaaccaataccggtacaaattcaggcagaaccaatacacataaagggaatacagataaaagtagtttaacaaataagaataaaacgagggcaaataaaacaagtacgaataaagttcaaagcgaaaaaaacggaacaggcgagacaaaaagagcagaaaaaaaaggcatgccggtcagaaaaaacagaaaaagttctgcagtttccgagaaaaaaacagaaacaaaaacggaatctcaactttatacagagatttttctttggattttagttgcagtttctattttgttaatgttaagtaattttggagctggaggcataattggaagttacatcagtaatttattttttggattatttggaattgtaacttatgtttttccggtgttcttattctttgtgactgcttttatgatttcaaacagcaaaaatccaagagcatatcgaaagatggttggatttttgttgatgtttgtagcggtttgcgcttttatgcagctattgacagatggatattatgagggaacgacattagaagaatattatcggatatccgccttgtcacaaagtggtggcggagtattgggcggagcgatctgcaatgtaacggcgaaagcatttggagtagccggtacttatgtgattttagttgcctctggaatcatttctgtggtacttgtaacgcagcaatctatgtttgaactgatgaaaaaaagcggaacaaaaatgtacgcaaaggtaaaattggagcaggaaagatgggaaaaacaaaaggcagctcaggagacagaaaattcagatgaactccagcttcagcagcacaaacagggagcaaagcactcaaaaattgccgatggagttacaaagatggcagcactttcaaaatcagctttaaagaaaaaagaagaggaagaaaaagagccaataaattttgacgatttacatgaaacagaagaaactgagtacattaaaaatatagaacaagaagaaaaagagggatttactcctcaaaatgcatttccaatccacagagccgaggaagtggcattgtgggatttagaagaattgacgataccaaagaaaacagaaaagaaacaacagaaagataaggaaaaagaacctgaaaagaaaaagctttcatctgtaaaagaaaatcagcagataaaagtacaacaaaaagaagcaccgccggccgtatatgaatttccgccgattacgttattgaaaaaaggagtgggaaatggtggtgactcagatgaccatttacgaaataccgcaaaaaaattgcaggaaactctgcacacatttggtgtaaatgtaaccattaccaatatcagctgtggacctacagttacgcgttacgaggtacagccggagctgggggtaaaagtaagtaagattgtaagccttgcagatgatatcaagttaaatcttgctgctaccgatatccgaattgaagcaccgattccaggaaaagccgcaattgggattgaagtaccgaataaacaaaacagtgtagtgatgcttagagacttaattcagtcagaggcgtttgtaaaatcaaaatccaagctggcatttgcggctggaaaagatattgcaggaaaaccggtgattgcagatattgcaaagatgccgcatcttttgattgccggtgcaactggttcaggtaagtccgtctgtattaatacattaattatgagtcttttgtataaagcttctccggaagaagtaaaactcattatgatagacccgaaagtggtagagttaagcgtctataacggaattccacatcttttgattccggtagtaacagagccgaagaaagcagcaggtgcgttaaattgggctgtcgctcagatgacggaacgttataatcaatttgcagaatacaatgtacgtgacattaaaggatataatgaaaaaatagaagtattaaatgcaaagaaaataaatcaggagacggaaaaactcttgaaaaagatgccgcaaattgtggtaattgtagacgagctggctgaccttatgatggttgccccgggagaggtggaagatgcaatctgccgtctggcacaacttgcacgtgcagcagggattcatttgattattgcgacgcaaagaccatcggttaatgtaattactggtttgattaaagctaacatgccatctcgaattgcattttcggtttcttcaggcgtagattcccgaacgatcatcgacatgaatggggcagaaaaactgcttggtaagggtgatatgttgttttaccctcagggatatcagaaaccggcacgtgtacagggcgcatttatcagtgataaagaagtatcagcagttgtaaaatttctttcagagcagacaaatggacagtatgaccatgaaattgagaaacagattaatactttgaaaggaacaaaacaggaagaagcttctttagaggctaatgagagagatgtttattttgcagacgcaggtaaatttattatagaaaaggataaggcatcgataggaatgcttcagcgtgtgtttaagataggatttaaccgtgcagcaagaattatggatcagttatgtgaggcaggagtggttggtcaggaagaaggtacaaagccaagaaaggttcttatgtccatggaacaatttgaacaatatatagaggaatatctataatggattttggcctgcatgattttattttagttgaagattgagataaaatcatgcagggcgagaaagaaaagaggttgtcttacatgaaatgtgcaaattgtggcacggaactaaaagatggaacattattttgtccggtatgtaaaagtgaaatacaatgggtgccggaatatcatacattggagacgattctgcttcaaaaacaaatgcgggagaaaaatttgaaagaaaaaaaacaaaaaaaggaagaagaactgcgccagaaaaaacgtcaggaagaaattcggaagaaaaaacggagaaaatatcaaatattcggagggagtattgctgccttgattttattggcaggtgtggcaggttttgcaattaagcggaaagaatataattcgtttgacatgcagatggcacaggcggagtcagaagtgacaaataaaaattatgaatctgctttaagctatctggagcgggcattggaattacagccggacagtacatcagcaaaaattctgcaggcaaaaatttatacagtaaacggagaggaagaaaaagcacttcctattctttcatctgtaatagaaaaagaacaggataatgtaagtgcctatggagaactgttgagactttatgaaaaacagaaagattatgattcgattaagtcacttttagatgagtgtgataatgaaaaagtgaaatcacgttacgaagattatgtatgtgaagtaccggtaatttctttaaatggtggaacttacgagaaagaacagaggattgatttcactgccatgaaatatggaacaaaggtttattatactttggatggtagtgaaccagataagacaaatggaacacgttatgattcagactatggaattgttttatcagaagaaggagaatacacgttaaagtatattgcctataatgctaagggaatcccaagcgaaaataaagaagaagtttataagattgaatttaaagctccggatgcacctaaaatcacaccggattccgggcaatatgaaaaggcgacaaaaattcgaattgcagtgccgagtggctgtactgcttattatgcatttgatgatactgtgacgacagaaagtacaaggtacacaggaccggttgaaatgccagagggtgaacatattttttccgcaattttggtgaataaaaatggaaaaattagtttgactgcaagtgaaacgtatgtcttttaccagtgagaaactaggtttttttgtatgtttgaggaaaagtacgattttttaattgaattttgatgaaaattggattatactggttgatagcaatcatagcaataaaatattcccttttgggaattgtgaggaggacaatatgtacaagattctgaaagcagaaaagctgaatgaggttatttatctcatggttgtagaagcaccacgtgttgcgcagcactgccagcctggtcagttcattatcgtaaaaaaagatgatgagggtgaaagaattccgctgacaatctgtgactatgacagagaagcaggaaccattacaatcgtattccagccgattggagcttctactacaaaatttgcacagatgaaagagggagatttctttgaagactttgttggaccattaggatgtccatcagaattagtagaggaagatttagaagacctgaaaaaagaaaaaattttatttgttgccggcggtgtaggaaccgctccggtttatccacaggtaaaatggctgcatgaacatggtatcgatgccgatgttatcgttggtgcaaaaacaaaagatttaattattcttgaagaagaaatgaaagctgttgcaggtaatttatatattacaacggatgatggttcttatggacgtcatggtatggttacaaaagttattgaagatttagtagctgaaggaaaaacctatacaaaatgtgtttccatcggaccgatgattatgatgaaattctgttgccttacaacacagaagcttggaattccgacaatcgtatccatgaacccgattatggtagatggtactggtatgtgtggagcatgtcgtgtaattgttggagatgaagtgaaattcgcatgtgtagacggaccggaatttgatggacatctgattgactggaatcttgctatgcagagacagcagatgtacaagacagaagaaggacgtgcattattaaaacagcgtgaaggagatactcatcacggtggatgcggaaactgtggaggtgacaaataatgggtgacgtattaaagaaagttccggttagagaacaggacgcaaaagtaagagcaacgaactttgaagaagtatgtttaggatataataaggaagaagcagtagaagaagcaaatcgctgtctgacttgtaaaaatgcaaaatgtgtacagggatgtcctgtaaatattgatattcctggctttgtaaaagaagtaaaagaaggaaattttgaagaagcttataaagtaatcggaaaatcaagttctcttccggcagtttgtggtcgtgtatgtccgcaggaaagccagtgtgaaggaaaatgtatccgtggaatcaaaggtgaagcagtttccatcggtaaattggaacgttttgttgctgactgggcaaaagaaaatggcatcaaaccagaagcagcagaagtaaaaaatggacataaaattgctgttatcggttccggtcctgctggtcttacctgtgctggtgacctggcaaaacttggctatgatgtaacaatctttgaagcacttcatcagccgggcggagttttagtttatggtattccggaattccgtcttccaaaagataaagttgtaaaagaagagattgaaaacgtaaaatctcttggcgtaaaaattgaaacaaacgttattatcggtaaatctactacaatcgatgagcttcttgaaaaagaaggatttgaagctgtatttatcggttctggagcaggtcttccgatgtttatgggaatcccgggtgaagtaagcaacggtgtattctctgctaatgaatatctgacaagaagtaacctgatgaaagcgtttcgtgatgaccatgatacaccgattaaaactggtaagaaagttgctgttatcggtggtggtaatgttgcaatggatgctgcaagaactgcacttcgtctgggtgcagaagtacatattgtatacagaagaagtgagtctgagcttcctgcaagagcagaagaagtacatcacgcaaaagaagaaggaatcatttttgacctgttaacaaatccggttgaaattgttgcagacgaaaacggctgggtaaaaggtatgaaatgtgttcgcatggagcttggtgaagcggatgcttctggaagaagacgtccggttgtaattccggattccgaatttgaaatggatgtagacacagttattatgtctctgggaacttctccaaatccattgatttcttctactacaattggtcttgacacaaataagagaaaatgtattattgcagatgaagaaacaggaaaaaccacaaaagaaggcgtatatgccggtggtgatgctgtaacaggtgcagctacagttatccttgctatgggtgcaggtaaagcagctgcgaaaggcattgatgaattcatcaaaggaaaagaaaactaatcaaaagatgctaaaaaacccttctgctgctttggcggcagtagggtctttttgactttattcaaaacagatggagcaaatatgaagattacgctgattacagttggaaagataaaagaaaaatatttaagagatgcaattggagagtacagtaaacgcttaagtaaatattgtaaattagaaattattgaagtggcagatgaaaaaacaccggaacgtgccagtgaagtggtagaagagtccattcgttcaaaagagggagaacggattttaaaatatataaaagaagatgcttatgtaataacacttgaaattggagggaaacagctggcttcagaggaactggctgataagatagaacagcttggaatacagggaaaaagtcaaattgtttttatcatcgggggttcgattgggcttggaaaagaggtattaaaaaaatctaattatgccttaagtttttctaaaatgacttttccccatcagttaatgcgtgttattttgctcgaacagatatatcggagttaccgtattatcaatcgagaaccctatcataaataattctgctggcattttacgcattttgaatcacgactgcaatgaaaattaagaaccaaatcatctacgcgggtgcaggtggactttttataaagcacagtatgggtgacatcacttgcatcggtaagacacttggtatgatagattttcgtatattcatttgaggtatctgcagtgtctgacatcgtgggcatctcctttcaaggtaagtgataaatttatacttttagtataacggaaaagaagcaaaaagaaaagaaagttgaggaaagaaaatggtaacacacgaacaaattgaagaatttatctgtcagtatccggtgtatcagtatgctttttttaaacctgaagagattgaattttcttatcgggtgagatggatttgtgaacaggaatgtgagcgttataattctacctgggcatgcccgccggcagtcggaagtgtagaagaatgtaaacacagatgtctcaagtataaagaatgttttttgttttctacgattgcagaagtatccgatgtaattaattttgaagaaacacttgcaaccagagcggaacacgaagaggtaacagctgcaattgaagcatttataaagtcacagggaagcgagtgtatggcattgtccacagaatcctgcgacatttgtgatacttgcgcatatccagacggtccgtgtcgctttccggagaaaatgcatccttgtgtggaaagtcatggaattattgtaagtgagctggctgaaaagtttgatatggaatttacgttaagtccgaatcagattttgtggtttgggattttatttcttgcataaaaaatccgcataagaaattggtttttgcatatttatattaataagaagtatgggataaacggttcatgcgaaaaaaaagcgtcccacagaaactggcagacaagatgcagattccaaaagacttggcttatcaggagccagtgttaacgatgattggacaaagggaactttgtgttgaaaattataagtgtatccgatattatacggatagctgtattgttttgttaacaaagaatggtaaattgaagttagagggagacagactttccattcaatcgtatgataatgaagaaattagaattaccggaataattttcagattagaatttattggctaaaaagagttagattgctaaatggggaggaccaggtgattttaggaaaaaatttctggaaaggatatctcaggatttgtttttggggacaagaatcggaacgatttttaaatttgtgtgcacatcataagattcaaatttgtcagattgaaaaacacgaggcggtttattggggttatgtattgatttcagatttttatcggatggatgaagtaagaagaaaaacaggaactaaaattaaaattaaaggaaaatacggaatacctttctttttttacagaaataaaaaaagaagggtattttttgttggatttttactggcactgatagctgtatttttattatcagaaagagtatggaatattcatgtggagggaaatgttcataattcaacagaatcgattttaaattatcttgaaacacaggatgtatggcatggaatgagaagagaccaggtagaatgtggctatattgcagggaagcttagaaaagaatttccggacattacatgggtatcagcgaaattgacaggaacgagactcatgttagaagtaaaagaaaatgaaagctatcaaaaagaaaaacagttacaaaaaaaagaaatgccctgtgatttacgtgcacaaaaagatggaattatcttatctatgattgtaagaaagggaaaggcaaaaaagaaaataggagagaattgtagtaagaatgaaattttagtgtcgggaaaaattccaattataaatgatagtcaggaagttatgggatatcaaacggtgcaggcagatgcagatatcgaaattcaatataaaatggaatattatcaggagttttcgagaacctatcaaaagataataccgagtggggaaacaaggcagggttatatcattcaggcaggaaattattatcttgataccagtcgaaacttaaaaaagcaggaatataatcggttgctgaaacttcgacagttgaagctgacagaaaattttaagctacccgtgttctatggaaaaagtatagattatgcaatagagaaaaaagagaggatttatacgaagaaagaggcagaaaaaaaggcagagcagacaattttacgtgtgctagaaactttatcacaaaaaggtattcaaatatctgaaaatcatgttagaatagaggtaaacaagaacagctgtgtgacaaaaggaagtttgattttaattgaaaaggcgacttgtcagacaccgctgaagacagaaaggaataacagcatagatgagcaatataattgaatctcggatggattttccggcagaacatgaaaaaaatgtgtttggacaattcgacgaatatgtaaaaaaaatagagcgggcattaaatgttacgattatttcaagagatggaaaattaaagattttaggaaatgaaacttctgcaaatcaagcacagagggtgatttcacagttgttaatgttttctaagaggggaaatacgattacagaacagaatgtagattatacgctttctcttacctttgaagaaaaagagggacagatggcagagatggacagagattttatctgccacactatcaatggtcgtccgatcaagccaaaaacactgggacaaaagtcttatgtagatgaaatccgtaagaaaatgatagtatttggtgtcggacctgccggaaccggaaaaacctatctggcaattgcaatggcagtaactgcatttaaaaatgatgaagttggaaaaattattttaactcgtccggcaattgaagcaggtgaaaaactgggatttttaccaggggatttgcaaagtaaaattgatccatatcttcgtccattgtatgacgcactgtatcagattatgggaccggaaagttttgcaaaaaatatggaaaaaggtctgattgaggtggcaccacttgcatatatgcgaggtcgaaccttagataatgcctttattattctcgatgaagcacaaaatacaacaccggcgcagatgaaaatgtttttaactcgtattggttttggttcaaaagtaattgtaaccggagataagactcagaaagatttaccggcaggggtacgctctggattggatatcgcaatgcaggtattgaaaaaggtagatggaatttcattttgccagttgactaataaagacgtggtacgtcatccgctggtacaaaagattgtagaagcttatgatgagtatgagaaaaaacagaaacctcaaaaagaaacaaaagagatgaaaagaaagagggagtggaaatgactttaaatattgataaagaatatttgggagaactgggatttgattatgaaaaaattgcaaaagaagtagtggaagcagcactggattttgaaaaatgcccttatgaagcggaagtcagtcttgtacttacgacggatgaagaaatacgaaaaacaaatgctgagtttcgtaaaattgaccgtgtgacagatgtcctttcttttccaatgcttgactttgatactcctggagatttttcctttttggaagaagaggaagatgcatttcatccggataccggagaattgattttaggagatattatgattgcagtcggaagaatgagagaacaggcagaaacttatggacatggggaagtaagagagtatgctttcttaattgcacacagtatgctgcatctaatgggatatgaccatatggagccaaatgaagcggctgttatggaaaagaaacaggaagaaatcttagaagaacttggaattctccgtaaataaaaagtttttgaatcaaagattgaataaataaaaaaataaagtcgatactagtttcataaaaacaatttacgctcggaatctggtggcatttgatttaaccaaatcaagtaagtcttcgagggtaatgaacaatagtaaggagtgtcttttatgaaaaaaataatttctggtatcggcttttttttgtctgctcttgtaataggaaatggtattgtttcttattgtgaagtatctggcttaaaagagaggatacaggatttggagacagaaagtgactggattggaaagcaggtatcagctgttccatttaaccagaataaaaaatatgtatttgaatcttatgatgagaagagtggaagtgtaaaacaacaagtataccggattcactcttatggagaaaaccagattgtgcttcaaaaagaagaaccggacaatcaggagatttttttgataaaggtaaaagatgattatcttgccgtatacaaaaaagcagacaggcagttgtttgaaacgaccaatattccaatagaggcactgccttcagacgaacaggtacaagtgctggcaggcaaggaagtaacaggaacagaagcactttacagttttttggagaattattcttcttaaatcctactttacgaaagaaaaaaaatgtagtaagataaaaaaacatgaaacaaagccagaaatccttagcttttaatatagaaaaagtataaaaaggcgatacaggagaggagaatacatgaaagtacgagaccgattaaaagagaaaaaaagaatcgtagtaaagataggctcttcatcattgacgcatgaagaaaccggtcgtttgaatttgatgaaaatggaaattcttgtaagagagcttgcagatttacataatcagggaaaagaagtgattgtggtttcttcaggagcgattgcagtaggaagaagtgcgatgggaattgaccataaaccgaaggaacttgcgaaaagacaggcatgtgcagcaatcggacaggcacgcctgatgatgatttatcaaaaattgtttgcagaatacaatcagacagcagcacagattttgatgacaaaatatacgatgattaaccgtgcaacaagaattaatgcaaaaaatactttcgatactctgcttgagatgggcacaattccgattgtaaacgaaaatgataccatttctacagatgaaattgaatttggcgataatgatacactttctgcactggttgcggcgctgacaggggcagatatgttaattttgctatccgatattgatggactttttacggatgacccaaatcagaatccaaatgcagaatttattgatctggtagaaaaactggattctcatctggatgctatggcaaaagatacctcaaagagttctgtaggaactggcggaatggcaacgaaattaaaggctgcacatatagcaactagtgcaggtgctgatatggtcattgcaaatggaaatgatttccatgtcatacataaaattatgcagggaagaaatcatggaactttatttttagcagataagaaagaagagttttatctggatgacattattgataaattgggatagaatgaaataaatgtactaacagaaaaatttggagagcacagatataaagaagcggaggaattttcatgaaacaggaacagattgagcgaattaacgagctggcaagaaaatcaaagacaacaggtctgacaccagaagaaaaagaagaacaaaaaaaattacgtgcagaatatattgcatctgtccgtatgaatttgagaacccagttagataacattaacattcaggaaaaagatggaagtattgtcaatttgggtgagaagtatggaaaaaagaaaaagacacattaaaaaataagctaagaaagaaatagaaagggtatccgctgtcgggatgctctttttgtttcttaatgaaaattatagaatgtgaaataaaaacactctgtattgaaaaataaaaaagattaggatataatagaaaaattgataacagataaattagaatggagaaatacatgttaaaaaataaagaactggaagaaattttagaaaagattgacttaaatgaagcaccgccggcagaagagccgatgcgtcagtattattttatgaagaaagcgcagatgcttgtaaaacaaaaaagcgaagaactgggacgtcctttaacctatcacgtaacgactttcgggtgtcagatgaatgcgcgcgactctgaaaaattagtgggtattttagatgaagtgggttatacagaagtagaagatgaaaatgcggattttgttatctataatacttgtacggtccgtgaaaatgcgaatcagagagtgtacggtcgtttggggtatcttcacagtatcaaaaagaagaagccgcacatgatgattgctctttgtggctgtatgatgcaggaagcacaggtagtagaaaaattaaagaagagttattcttttgttaatctgatttttggtacacataatatttacaagttttcagaattgattgtaacagcgttagaatcggaccgtatggtcattgatatctggaaagatactgataaaatagtagaggatttgccaagtgaacgtaagtatgcctttaaatccggtgtcaacattatgtttggttgtaataatttctgtagctattgtattgtaccttatgtaaggggaagagaaagaagccgaaatctaaaagatattgtccgtgaaattgaaaagttagtagaagatggagtaaaagaagtcatgcttcttggacaaaatgtcaattcctatggaaaaaatttagaagagccggttacctttgcacagttgttaaaagaaatcgaaaaaatcgaaggcttagagagaattcgttttatgacttctcacccgaaggatttatcggatgaattaattgaagtgatgaaagacagcaagaaaatctgccgtcacctgcatctaccacttcagtcagggagcagcagaatcttaaagattatgaatcgtcattatgataaagagcgttatcttaccttagtaaagaaaattaaaacggctatgccggatatttctctgacgacagatattattgttggatttccgggtgagacagaagaagatttcttagaaacaatggatgtggtaaaaaaagttcgttttgacagtgcatttactttcctttattctaaacgaaccggaacaccggctgctgtaatggaaaatcagatttcagaagatgtaatgaaagaccgttttgaccgtttgttagaagaagtacagacgattggaagggaaatgtcatccagagatacaggaagtgtacaggaagtactggtagaagaggtgaatgagcatgacccttctttagtaaccggaaggatgtctaataatttactggtacattttcctggagatgcttcattaattggaaatattgtttccgttcaccttgatgaatgtcgcggattttattatatgggaacaaaggtaggctaaaagaaatgggattgaagataaaagacgtagaggtatcatccttatcaccgatgatgcagcattatgtaaagacaaaaaacgaaaataaggattgtattttgttttatcgtctgggagacttttatgagatgttttttgaggatgcagaagctgtttcaaaagaattagagttgacgctgacgggaaaagactgtggattaaaggaaagagccccgatgtgcggagttccatttcatgcagcagatacttatatcaatcgtctggttgaaagagggtataaagttgctatctgtgaacaggtagaagatccgaaaacggcaaaaggcatggtaaaaagagaagttgtccgtgtcgtaacaccaggaacaaatttaaatacacaggctttggatgaaaccaagaacaactatattatggcgattgtctatctttccaatcgttacggaattgcaattgcagatgtgactaccggtgatttcatggtgacggaagtagaaaaatcaagaacacttttggatgaaatatataaattttcaccggctgaaattatctgtaatgagtccttttatatgagcggagtggatttggaggaattgaagaatcgtctgcacatctgcatgaatccactggagggctggtattttgatgatgaattatgcgtaagaactataaaagaacattttcatgtcagtgcattagaagggcttggattaaaagattttgcctgtgcaacgattgcagcaggtgcgcttttgacctatcttttagaaacccagaaaactccgcttgaccatctgcgtgcgattatgccttatgcaacggaacgttatatgattattgatagttcaaccagaagaaacctggagctgacagaagcactcagagaaaaagtaaaaaggggttctcttttgtgggtgttagacaaaacgaaaaccgcaatgggagccagaatgttacgttcctttattgaacagcctttaattgatgagcatgcgattaatgaccgtcttgatgcgattgaagagattaataagcgggaaatggaccgcgaagaaataagagaatacttaaacccgatttatgacttggaacgtctggtaggaaaaatcagttatcagtcggcaaatccaagagatttgattgcatttaagtcttcgatttccatgcttccttacataaaaggactgataaaagaatttaaaagcgaagagatgcagtctatttatgaaaatatggatgatttgcaggatttatttgaacttttaaatgcatcgattatagaagaaccaccgcttgccatgaaagagggtggcatcattaaagatggctatcatgaacaggtggacaattttagacaggcaaagacaaagggaaagacgtggctggcagaactggaagcttccgagcgtgaaaaaacaggaatccgtaccttaaaaatcaaatataacaaagtctttggatattatcttgaagtaaccaattcgtttaaagatatggtgccggattattatacgagaaaacagaccttgacaaatgccgagcgttatatcactccacggttaaaagaactggaagatatgattttaggagcagaagataagctgtatgcgttggaatatgaaattttttccggtatcagaaataaaattttccaggaagtggaacgagtacagagaaccgcaaaagcgattgcaagattagacagttatctttctttggcacttgtggcatcgagaaataattatgttcgtccaaaaatcaatacaagaggaatcattgatattaaaaatggacgtcatccggttgtcgaacagatgattccgaatgatatgtttattccaaatgatacttacctggataatgcaaaaaaccgtgtctcagttatcacaggaccaaatatggcaggaaaatcaacctatatgcgtcaaacggcattaattgtactgatggctcagattggttcttttgtgccggcagaaaaagcaaatatcggtattgcagaccgtatttttacaagagtaggagcgtcagatgatttggcaagcggacaaagtacctttatggtggaaatgacggaagttgccaatattttgcgaaatgcaacttcaaagagtcttttgattttagatgaaatcggaaggggaacaagcacttttgatgggctttcgattgcctgggcagttattgaatatatcagtaacacaaaagtattaggagcaaaaacgctgtttgcgacgcattatcatgaactgactgagttagaaggaaaactttccggagtaaataattactgcattgcggtaaaagagcggggagatgatatcgtatttttgcgtaaaatcgtaaaaggcggtgcagataaaagttatggaatccaggtggcaaaactggcaggagtgccggatgtggtcatcgaacgagcaaaagaactggtagaagaactttccgatgcagacatcacagcaacagtaaaagatattgctttggagcgcaaaaaaggaaaaacgaaagcaaaatctcaggtgcatttagatgaggtggatttagaacagatttctctatttgatacggtaaaagatggtgacgtgttagaggaactaaaaaatattgatgtctcaaatctgacaccaattgatgcgttaaatacaatctataagcttcagaataaacttaaaaatcggtggtgaatcaattgagaaaaattgcagtattagaccagagtacaattgataaaattgcagcaggagaagtcgtagaacgtccggcctccgtggtaaaagagttagtggaaaatgcaattgatgcaggctctactgcaattactgtagaaattaaagagggcggaatttcatttattcgagtaacggacaatggaagcggaatggaaaaatcacaggtcaaacttgcgtttttaaggcatgcgaccagcaaaattgaaaaagtggaagatttgctggaaatagaatcgcttggatttcgaggagaagctctttcgagtatttcagcggtggcacaggttgaaatgattacaaaaacagcgcagtctttaactgggattcgttatctgatagaaggcggaatggaaaaggggttagaagaaatcggagctccttgtggtacgacaattctggtacggaatctgttttttaatacacctgcccgagcaaaatttttgaaaactccagttacggaagccggctatgtcagcacctatatggaacagcttgccctgtctcatgcacatatttcatttaaatatatggtaaatggacagacaaagcttcatacttcgggaaatgcgaatttaagagatgtgatttacagcatttatggacgtgagattacaagagaattgattccaatccagtgggaacaaaatggaattaaattagatggatttgcaggaaaaccagtgattgcaagaggaaaccgcgcctttgaaaattattatattaacggacggtatgtaaagagcaaaattattatgaaggcaattgaagatgcctataagccctatatgatgcagcacaaatatccgtttgtgtgtctgaagtttgaagttccgggagatgaagtggacatcaatgtgcatccaacgaaaatggaagtacgatttcaaaaacaaaaggagatttatgagtcggtttatgaagctctgctttttgcaattggaggaaaagagctgatcccggaagtaaaatttgaagaaaaagaatcagaattaaaaaaagtggagtctgataagaaagtccacaaaaaagaaaatggtccagagccatttgaagtaaaacgaaaagagagctttttggaagcactttcttttggacaaaaaagagaaccacaaaatcaaattcgggaagacagaccagaatggaaagcaaaaaaagaaccacagtcaaataatgtgagtgttcaaccggataaagtcaaagatacagaagttggagtttctcaggtaattgaaaaaaaagagaatcaaagaaaagaaactattttggagacagtttcagaagagggtttagaaaaacaggcagaagctgtaaaactggaaacaaaaacacaagaaatcagacaacccaaattggagcagcgggaagaaacaaaacagatggagctgtttgatgacaggttgttatcaaagaggtcaaggaaacatcatcgtattatcgggcagttatttgaaacttactggttagtagagtatgacgaaaaattttatattatcgaccagcatgctgcacatgaaaaggtattgtatgaacgatttatgaaagaatatgaaagtaaaaatattctttctcagattatcagtcctccacagattatcagtttaagccttcaggaagcagaacttctaaaggtaaatcagaagctgtttgaagaatttggttttgaaatttcttcatttggaggaaaagagtacagtatcagtgcagtgccgtcgaatttatatggagtcgatgtagaagaactctttcttgaaattttaggcagtcttgatttagaaggcagtcataaaacaccggatttaatccgatatcggatcgcaacttctgcctgtaaagcggcggtaaaaggaaatcagacactttctgttttagaagcagataaactcattgatgaattgcttgggcttgaaaatccttatcattgtccacatggaagaccaacgatagtttcaatgacgaaatatgagttagaaaagaaatttaaaaggattgtgtaggtgaaaaaagtgcagaaacctctgattatattaacaggtcctacagcagtagggaaaacaaaactctcgatttctctggcaaaagcggtaaatggagagattatttccgcagattccatgcaggtataccgccacatggatattggttcggcaaagattaggtcggaagaaatgcagggagtgaagcattatctgattgacgaattagaaccggaaaattcttttcacgtggtagaatttcagaaaatggcaaaaaaagcaatggaagaaatttatgcaaaagggaaaattccgattttagcaggaggaaccggattttatattcaggcaattgtaaaagatattgatttttcagaaaatacagaagcaggaagttatcggaaagaattagaagcgatggcaaaagaaaaaggagtacattacctgcatgaaatgcttgaaaagatagatgaagtttcagcacaggcaattcatgaaaataatgtgaaacgtgtgattcgtgcattggaatactatcatttgacaggagaaaaaatttctgttcataatgaaagagaaaccaaaaaagaatcgccttattgctttgcctactttgtattgaatgatgaacgggaaaaactgtatcagagaattgaacagcggattgatgagatgcttgaaaatggtttaatcgaagaagtaaaagcattaaagagaagaggctgtacaaaagatatggtttctatgcagggactgggatataaagagattttgtcgtatttagatggagagtattcgctggaagaggctgtttatattttaaaacgtgataccagacattttgcaaaacgacaaattacctggtttaagagagaacacgatgtaatctggctggaaaagccggaatttgactatgatgaaacaaaaatattaaattatatgcttaagatatgtaaggagaaaggaatactataatgcaggaacttagttcaatgtacagtgaacttggaatttcaaaagaagtgctggagtacggaaaaaaaatagaagaaaaattaaaagaacgatttgaaaaaattgatgagacagcagagtataaccagttaaaggtgattcatgctatgcagaaacataaagtaagcgaagcatgtttgtattcttccagtggttatggatataatgatttgggaagagatactttagaagaggtttatgcagaagcgtttcatgcagaagcagctctggtgcgccctcagattgcatgtggaacgcatgcgcttgcagttgccttatctggaaatttgcgccctggagatgaactgctttctccggttggaaaaccgtatgatacattagaagaagtaattggaatccgtccatcaaaaggttcactggcagaatacggagtcacttaccgtcaggtagaattattagaagatggaacatttgattatgaagcaattaaaaatgcaatcaatgaaagaacaaaactagtagagattcagcgttccaaaggatatttaactcgtcctacgttttctgtaaaacagattggagagttgattcattttattaaagaaattaagccagatgtaatctgtatggtagacaactgttatggcgaatttgtagaacggatagagccgagtgatgttggtgcagatatggtagttggttctctgattaaaaatccaggaggcggattggcgccaattggtggttacattgtaggaacaaaagaatgtgtggaaaatgcagcctatcgtctgacctctccgggacttggaaaagaagtgggagcaactttaggtgtaaacccagcgttttatcagggatttttccttgctccgactgttgtagcaggtgcattaaagggagctatttttgcggcaaatatttatgagacattaggatttgatgtcagtccgagtggaagcgaaagtcgtcatgatattattcaggctgtaaccttccatgtgccggaaggagtcattgagttttgtaaaggaatccaggcggcagcaccggttgacagctttgtagagccggaaccgtgggcgatgccgggatatgacagtgaagtcattatggcagcgggagctttcgtccagggttcttcaattgaactttcagcagatggaccgattaaaccaccgtataccgtatattttcaaggaggtcttacttgggcgcacgcaaaatttggaattttaatgtcacttcagaagttagtagagaaagagattgcagtgcttccaaaataggagaacaaacaaaatgaaacagataagagtatgcgtaattgggggaggcgcttccggtctgattgcatctatttttgctgcaaaagaaggcgcagcagttactcttttggaaaaaaacgaaaaacccgcaaaaaaacttttgatgaccggaaatggtcggtgtaattttacaaatgaatatcagaaattggaatgttatcacagttatcacgaaaaagagtcacaatttattcgtgaagtgtttgagcaattttcgatggaagaaacggtaaagttttttaaaaggattggaatttatccgaaaagccgaaatggctatctttatccagccagtaatcaggcatcaagtgtggcagaagtcttagaagcagaggcacgttttcgaaaggtaaaaataaaattgaacgaacaggtgcttgcaattgaaaaaaacgaacaaagtgatacgtggctggtaaaaacaaaaggctggcagtatgaagcagagcgaattattattacttgtggttctcctgcttctcttttagaagaggatggctgggatggatatacgtttgcaaaaagcttagggcatcagattgtgccggtacttcccgcacttgttccattaacctgtaaggtcggatttttaaagcaatgggctggtgtgagagtagaaggtcaggtttcttttatacagaaagaggaatgccttgcccgtgaaagaggagaattgcagctcacagaatatgggatttcgggaattccggtttttcaaatcagtgcgtgtgtagcaagaaatttatcagagaatggtcagggaagcgttgtgctggattttatgccagattttacgatagaagaagtagaagcattattaagggaacgtcaggaaaactgtagctacaaaaacttaaaagaattgttgatcggtttatttcctgcaaaactgattccgatactggtgaccaaaaagataacagaaaaagaactggcattccgaataaaaaatttggaacttccgttaaagggaacaaaatccattcgtcaggcacaggtatgtcagggcggagtcagtgtttctgagataaatgaaaaaacaatggagtcaaagcgttgtcctggtatttattttgcaggtgaggtcattgacgtggatggaatctgtgggggatataatctgcaatgggcctggtcaagtggtgcgatagccggaatgtatgccggaaaggagaatacatgattacactacagcaagtaaaacttccaatttctcatacaaaagaagaattggaaaaaaagattttaaagacattgcgaatcaaaaaagaagaactgcttgggtatgaaatcagaaaacagtctttggatgcaagaaagaaaccagaattgttctttgtctataccattgatgcaagtgtaaaaaaagaagagatcgtaataaaaaaaataaaagaaaaaaccgtatcaattataaatcggaaaaaatttgaatatccagctgtaatagaatggtcaaaagcttcacgtccggttatcacagggagtggtccggcaggattgttctgtgcgtattatcttgcaaaagcaggacttgctccgcttgtgattgagcgtggtgacccggttgagacaagaatggaaaaagtagagacattctggaaagaagggtttcttgatacagagtcgaatgtacagtttggagaaggcggtgccggtacattttcagatggaaagttaaatacgttagtgaaagatgcgatgggaagaaatcacgaagttcttcgtctatttgtagaatgtggagcacccaaagaaattttatatgtacaaaaaccgcatcttggaacagatttattggttacgattgtaaaaaatcttcgccataagatagaagaattgggaggagaaattcgtttccgcacaaagttgacacaaatttggcaggaaaatggcaaattaaagtccattattgtaaatggagatgaagaaattgcgacagattttctggtgcttgcaattgggcacagcgccagagatacatttgaaatgttagagcgagaaaaatttctcatgcaggcaaaatcatttgcagtggggcttcggatagaacatccacagtccatgattgatgaatatcagtatggtacaaagaaacatgcaggaaaacttggagctgccagttataaactgacccatcgagcagaagagggacgaggcgtttatagtttttgtatgtgcccgggaggatatgtggtcaatgcttcctcagaagagggcaggctggcagtcaatggaatgagctatcaggatagaagtgcgaaaaatgcgaatagcgcaatgatcgtcagtgtaaatccgaatgatttttgttctcaggatgcacttgccggtgttgcttttcaaaggcagttagaagaaaaagcctatcagttaggaaagggaaaagtgccagttcagctctttggtgattttatgaaccatagaaaaagcagtggatttggcatgattgatacttgtatgaagggagcttatgaatttgcagacctaaatgaattacttccagaatttttaagccgtccaatgaaggaaagcatttcttattttgggcggattatcgctgggttttcaagggaagatgccgtgttatcaggaattgaaagtcgaacatcctctcccgtaaggattgtgagaaaagaagactttcagagcaatgttgagggagtctatccttgtggagagggtgcaggatatgctggtggcattacatcggcagcaatggatggcttgaaagtagcagaggcaattgtgaaaaatacaataaatttttgagattccatatacatcgtttttaatctgtgataaaataaagtttgctgaattgataccctgtatttggctgaagagagtatatggtatcttatgtacaatgcaagaaaaatgaaagaaattcccgaagaaaaccgaccttatgaaaaatgtcttaagtttggggtcgaagcgctgacggatgaggaacttctggcaattttactgcgcagtggttcgaaagaacattctgcattagaacttgcatatcaagtcctgcatttatcaaaagaaaatcagggactgcaaagtatttatcatttaagtgtacagcagttgaaaagcattcatggaattggcgcagtaaaagccattcaattaaagtgtatgggagaaatttccaagaggattgcagtaaatgttgcagcgaagggaatctcatttgactgtccggcttctattgcgaaatactatatggaacaactgcgtcatgaagaacaagaacatttgctgtgtatgatgctggactgcaagaaccatcgtcttggagaagagcttatttttaagggaacagtaaatgcatcttatgtcagtccgagagagattttcttaagtgcgatgtcgtaccatgcagtcgggattctgctggtacataaccatccaagtggagacccgtctccaagtcaggcagatatccaagtgacgaagaagatacagacagctggaatcctgcttgatatacctctgatagaccatattatcataggggattgtcagtatatcagtttccgggaaaggggacttatcgaaacataaaaaaggggagcagaatatgccactttacaaaacatttggtgtagatttaggaaccagtatgattaaaatctattctgcacagaatgattcaattctaaaagaaaagaatatgattgcaattcgcaatgaaaatcaaattctggcttccggtaatgaagcatacaaaatctacgaaaaaaacccatcgaatgtatccgttattgagcctatggcatttggaaaaattgcagatatcaaccgtacagaaattgtactgcagtccctgcttaaaagagcaggttctcagcaattttttgggaattcggtatatcttgcagttccgacagatttgtctgagattgaaaaaagggcttattatacaatcggaaattccaagagaaaaaataaagtttatatggttgaaaaaccgattgccgatgcagtatcacttggacttccaattaatcatacaagcggaagtatgattgtaaatatcggtgcacaaagtactgaaatttcaattattgaaaagggaagagttgtcatcagtaaaatggttgaagttggaggaaaacagcttaatgaagccattatcagtatggtaagaagaaattgtaacctgaatataggagaacgttcggcagccagactgaaactgtcgctttcctatttgaaagatgacccgcaggaggtaagaaaagtagtgggtgttgattggattaccggtctgccacaggtgggggtggttacttcggatatggtgaatgaagcgattgaagaaccgtttttgaaaatctgtgaagaaatccgattctttttagaccgcattcctccacaaatctattcaaacatagcagatgaaggtgtatttttaattggaggaacaacaaaaattccaggagttggctggtttatcagtcaggaggtaagaatacgggttcgtctttctaagtatcatgatttatgtacgatatacggaattaaagaaattataggaaacaaaacactctggaaatgggtaaaataggaactgaggttgtacaatgaaaaaaaaacgcaattggaatttgaaaagtaaacacattctcataattatggtcgttgtctgtgttggattaatgctgcttacatttgctgcgaaatttccagtacagtcagtccggacaacagcaggttatacaattgtaccttttcaaaatggattgaataaggtagggaatgctttggatggatttacggaaggattccgaagcaagaaaaaactgattgaagaaaataaagcattacaaagtaaagtagatgaccttactgcggaaaacagcaggctgacacaaaatgtaagtgaacttgccagactgcaggagttgtatcaattagatcagcagtataatgaatatgataaaatcgcagcagaagtcattgcaaaaaattccggaaactggtattctacgtttaccattaatcgtggaagtgaagacggaattttagtagaccagaatgtaatagccggaagtggtttggtaggaatcgtaacagaagtcggagcacattgggctaccgtccgttcgattattgatgattcaagtaatgtaagtgcaatgacagtaagtacatctgcaaactgtgtggtgtgtggtgatttaagactgatggatgagggaaaactgcagtttattcatttaaaggatgatgaagataaggttcaggaaggagaaaaaatcgtgacttctgcagtcagcgataaattcttaaaaggaatcttaattggctatgttagtgaaattgaagaagatccaaataatttaacaaaaaccggaacattaacaccggcggtagactttgagcatttacaggaagtactggtgattaaagagttaaaacagcagaaggaggaagataaatgagaatacgcagaaaaatagtactgtttcttctgcttctggtttgttttattgttcagggaacattcttgaaagtaattgcaattggctcgatttctccaaatttgattctgatttttgtagtttcttttggatttatgagaggaaaaagaacaggaatctggacaggatttgtatgtggcttatgttgtgatttgctgggagatggaatcctgggatattatgcactgatttatttattaatcgggtttggagcaggatgctgttgtaaactgttctatgatgatgaacttcgagtaccggtgcttattgttgccgtgtgcgacctggtttatggaggaatggtatatgtgttgggatttctgcttcatggacgaatccagttcttttactatttctctcgaatgatgataccggaaatgatttatacagtactgttaactgcaattttgtataaagtctttttaaagataaataagaagctgacagagctggagatgaaggagcgagattccatttggttaagaaaataaaaaaaatacttaataaattatgcataaaaagaacaacggtattatttattgtttttgcagtcatgttttttattttactgcagcgtctgttcgttcttcagattatcaagggcgaagaatatgcgacaaattttaatctgacaacaacaaagacaagaacaattaagagtacaagaggaaatatccgtgaccgaaacggtgaactgcttgcacataatcagctggcctattccgttattatcgaggataatggaacgtatgattctactcgagaaaaaaatcttacactgaatcatgtggcttatgagattttaaaaattttggaagaaaatggagaatctgtggatgttaccttccatattacactagatgaaaatggagagtatgcatttgataccactgactttaccttagatcgttttaaggcggatgtttatggacaggctaaaattgatgacttatctaaagaggaagcaaaagcatccgcagccaggatgatagaagatttgtctcaggcagaccgttatggacttgtaaataaaaagaaaccatatacggaagaagaacgaaaagagtatggactgccggaaagttttacaaaagaagaagctttggatatcatcaaaattcgttatgcacttgcagcaaacagtttccagaaatacatgccggcgacaattgctacaaatgtaagcgaaacaacaatggcagcaattatggaggaaaaggatcagctccagggagtggatattcaggaagactccattcgggtttatgaggatagtgagacatttgcgccggtcattggttataccggaaaggcttcatccgaagaactggatgaacttaaaaaagaaaattcgaattattcttcggatgcagtaattggtaagactggtatggaacagtatatggaattacagctgcagggaacggatggagaagaaaagttaagtgtagataatcttggaaaagtattgaagattgatgaatcttctaaaaaagaccctatatcgggaaacgacgtttatcttacaattgataagaatcttcaaaaagcagcttatcagattctggaacagaaaattgccggtattctggcaagcaatattatagctggaaagacatttgataaaacggggctggattcaagtgaaatccggattccgatttatgacgtctataatgcgttgattgaaaacagtgtgattgatatcagccattttaaggaagaggatgcttctgaaacggagaaagcgatttacagtgtcttttcacaaaaacagagtgaagtgtttgactctgtaaaagcagagcttactgtctcaaatccggaggcatttgataaactgccacaggagatgcaggattatcagagttatattgtaaatgattttctgattaataaaaagggaatcctgtcgttagatgcaatcgatgcttctgatgcaacttatattgcatggagtaaagaccattctattagtttaaaggaatttcttacttatgcggccagtcagaactggattgatatttcacaattctatgcagaagaagaatatctggattcttctgaggtttacgatgcgctgtccgattatctgacagaatctttgacgacagacagtggattctcaaaaattatttacaaatatatgttacaaagtgatttgatttccggcacacagctttgtctggtcttgtacgatcagggagtattagaagcagatgaggcaacctattcggcgctccaggcaggacaaaaaagttcttatgattttatgttagataaaattaacagtctggagattacaccggcacagcttgccttagacccatgctccggttctatggtagtgacaaacgtaaaaaccggagagatactagcctgcgttacttatccgggttatgataacaatcgtctggcaaaccagatggatacggattattattcgaaattgtcttctgatttatcaagaccgttttataataaagcaacgcagcagaaaacagcacctggttctacctttaaacttgtaacggctcttgccggaatggaagaaggtattgccacaagtgattattatgtcaattgtacgggggcttttacaagaatttcaccggcaatcaactgttggtatcatgcaggacatggaacccttggagttcagggggcaattaaaaattcctgtaatgtattttttaatcagcttacttatgatatgggaaaagacaaaaatggagaattttcggattcaattggtcttagcaagctgcaaaaatatgcaaaaatgttccagttagataaggaatccggaattgaacttccagaagcagagccggaggtaacagatgaagcagcaatcgcttcttccatcggccagggaactaataactatacaacttctcaacttgcccgttatgcaaccacaatcgcaagtcgtggaacaagctattctatctcactgcttgataaagtgacagattctcaaggaaatttggttaaagattatacaccggaaattattaatcagatggatgtttctgattctgagtgggatatcattcataatggaatgagagaagtagtagaaaataatgcggcgtttgatgacctggattatgcagtatccggaaagacaggtactgccgaaaatacaggacatccaagtcatggtttatttattggatttactccatcggatgaccctgaaattgcaatggcagtgcgtattgcaaatggatatagttcaacaaatgcggcagcagttgcaaaagatgtcatcaagtacgaatataatcttgcagatgaatcacagttgttaagcggaaccgctacttctggagaaagcacagcgcagacagactaaacaattctattgggaggatggaacatgtgtgaaattattgtaattacttccggaaaaggcggtgtgggaaaaacaaccgtgactgcaaatattggacttgggttggcgaacttaaataaaaaagtggttgttgtagatacagatattgggttaagaaatctggatgttgtattaggtctggaaaacagaattgtttataacctgattgatgtcattgaaggcagttgtcgaatgaagcaggcattaataagagataagcattgtgaaaacttatacctgcttccatcagcccagacaagagataaaacttctgtcaaaccggaacagatggtaaagctgacaaaagatttggcggaagagtttgactatattttactggactgtccggcaggaatcgagcaagggtttaaaaatgcaattgcaggtgcaaatcgggcggtggtcgttaccactcccgaagtatctgcaattcgtgatgcagatcgaattattggtctgcttcaagcaaatcagatgccaaagatagaattaatcatcaaccggcttcgtatggatatgattcaaaaaggagaaatgatgtcggtagaagatgtgtcagaaatattggccgtagatttattaggtgcagttccggatgatgaggctgttgtgattgcaacgaatcagggagaacctctttgtggaaaacagtctttggcaggacaggccttttggaatatctgtcggagaatttgcggagaagccgttcccctgcttgattttgaagtgaaaaaagggttatggaagagattctcagaactgtttagaagatagtcaattttataaagggggcgccggcattgattcattttaggaagaaacgctcaggtcatatagcaaaagaccggcttaagcttcttttggtttcagaaaggcttagttgttctccacagatgatgaccatgcttcagaatgatgttgtatcagctgttgaacggtattttaccatttcagaggaacaagttgaaatacggtatataaaagaggatatgacatttctgataaagatacctttaaaaattgatatacaagagtcctatccaggattctgaaacagtcgccttgtgtgagactgtaagtaaaaaatgaattgagaaactgataaaaagacagaaaaaagaacaaggtgtttttatgataaaacaatatagattacgagattataattttagactggttattttcctgattggacttacttttactggagtgcttttagttggcagtgcagagccggcacttagaaataagcagttttttggaatgatgcttggagttgccatcatgctgattgtttctctgatggattttagctggattcttaacttttactggatattatacggatgtaatattatattgctgttgtctgtctggatttttggtacggaatcaaatggtgcttcaagatggcttagaattggaggatttcagtttcagccgacggagctttcaaaaatattgattgtcatgttttttgcacggttttttatggaacatgaagagaatttaaatacactgcggactttagttcagacagctattctggctgctattccgttaatgttgattttcagccagccggacttgaaaaatacaatcacagttgttatactgatttgtatcatgttatatcttgcaggcctcagctataaaattataggtggtgcaattttaattatcgtaccgcttgtggttgtatttttgtttattgttgttcagccaaatcaaaaattaattaaggactatcaaagagaccgaattatgacatttcttcattcagaggaagaagaatattcagatgatgttattcaacagaataattcagtgatggcaatcggttctggtcagttgacaggaaaagggttaaataacaatgaggttgcatctgcaaataaaggaaactttgtttcagaaagccagacagattttatcttttctgttgcaggagaagagttaggctttattggaagcgcagcgatattaattgttttattcctgattatctgtgaatgtattcggacaggatggaaagcgaaagatttgtcaggaaagttaatttgttgtggagtcgcttcgattattgcagttcagggattcattaatatttgtgtggcgactggaattgcaccaaatacgggaactccgcttccttttgtgagctatggactttcttctatggtatcactttatacaggaatgggactggttttaaatgttggtctgcagaaaaacagagattacagggaggttggtaaattatgaatattggacttatcgcacacaattccaaaaagaaactgatgcagaatttatgcatcgcgtatagagggattctttcaaaaaatacactttatgcaacagggacgacaggccgcttaattgaagaggtaacaaatttaaatattcataaatttcttgccggtcatcttggtggagaacagcagatgggggcattaattgaacagaatcagatggatttagtgatttatcttcgagagccattagcaccgcagaagcatgaccctgatgtaaaacgtatttttcatctgtgtgatacacataatatcccgctggctacaaatcttgctacggcggagatggtgataaaatccctggatagaggagagttagactggcgtgaaatgtacaaataaaagtgaaagacgaagacagagaaacaaaaatctgcttatggggatgggcgttgttattgttgtacttctgattgttctggcagttgttttaatcaagaagaaagatgcctctatgccggtttcttttgacttgacaacagaagtatttgggcagacagtagaggaagaagctctgacagcagacggattggcagcggatttatgtgtaggagctggagatacggcactcgatggtgtggaaacgcagggagatgagagagctgctttatttgatatccagaataaaacactgctgttttctaaatctttatatgaaaaatcctatccggcaagtatcacaaaaattatgacggcacttgtggcaatggaacatgcagatatggatgaagtcgtgacgattacagcgtcggatgttgctcttagtgctgattcacaggtgtgtggacttgcagaaggcgaccagattcagatgagtgagctgtttcatgcgttgttagtgtattcggcaaatgatgcagcaatggcaattgcaaggacggttggagatggaagtgtagatacttttgtacagatgatgaatgagactgcgcagagccttggaatgacaggaactcattttgtaaatccacatggacttcatgacgatgaccattatacaaccgtttatgatatctatctgatgttaaatgaagcaatgaaacatcaggaatttacagatattacacaattatcaaattatacgattacgtatacttcagcagatggaacacagcgccagaaatggcttgatgccacagatcaatatctgacaggagagtcaagtgctccaaaaggggttactattttaggcggaaaaacaggaacaacagataaagcaggcgcatgtctggcattaatggttcagaataattatggtgaaccttatgtctcaattgtgttagatgcgtcaaataaaccggaactttatgaaagaatgaatcaattactggagaaagtaaaccactcttaacgaaaaatgcgaaaaaattcacagaaaaatgaaattaaccattgtattcttgaacgaaatgcactataattgatttcaagataaccacgtttttagtaaaaatacatattacgtgcggctaaggaggaaaatgcgatggttcagttaattgtaggtgaaaaaggtaaaggaaaaacaaaagtacttctggacaaggcgaataatggtgtcaaagaagcaaagggctcagttgtatatctggacaagagcacaaaacacatgtacgagttaaataacaaagttcgtctaattaatgtgacagaatatgaagtggaaaatgccagtgaatttgtaggatttatcagaggaattctttctcaggataatgacttagagcaggtttatctggacagctttttaaaaatcgcaaaattagaggctgaagatgccccgcttacagaagtacttcaggaattagaaaagcttagtgaaagatttggattatcttttatcatcagcgtttccagaaatgaagaagaccttccggaagcagtaaagggaatgattgaaacttcactgtaaaaaaacaaagtaaaaacagtcactgtacatcaagagagaattgagtgtacagtggctgtttttttatttcatagtaagtttgctctatgaaatagaaagtgagtaaaaatttgtttttacgagctggcacttatatctcgaattcgaccaaacaggctgaaaagataaagtccgcagatgcctacaagaacatagacaattcttgaaagccaggataaattaccaaaaagaaatgcaaccaaatcaaaacgaaacaggccaatcagcccccagttgacagctccgataatggtaatgaccaatgctgtgtaatctaaaccatttgacttcatatgtttgcctcctttgtttctattttctgcctttttgataagttttatgcaaaaaaattaggtgttgccctaaaatgctgaaaatgataaaatgaaaaacggtacgaaaggagacgaaagattgtttattataaaaaagctatggaataaaataaaaaaattgccaagaaaggcaggaaggctgttgggaattcttggagaaatactctggatattatttcaaaaggcaggaagaatcttgaaaaaaggtcttcaaaagatacctcgtaatccgattgtagttgtaatcggtgttattatcatttatctgatagtgacagcaggtctgtatttttcttctgaacagattgaatcgtatcaagtgacatcaggaacgcttgaaaaaaacccagtttatacagcactggcaattcgagaagaaaaagtagtgaatgcaagtcaggatggatatttaagatatctgagaaaagaaggttcaaatgttgagaaaaatggaaacgtttatgcagttggggacagcgagattcaaattgcgaaatatgcgttagatgaaacacaaaaaagtaaaataaagaatgcggcagaagctttctctggaacgtttgattcctctgattttgctgatacatacagcttgaagtatgaattaaatggaatgatacttcagacagataaagcagaacagacggaggatacttcggacgaagaagagtatgatgaaaatggatttttagtggtaaaaggaaatacttcgattatgttaggaaatcaaaccgtggttacttcaccggatgctggaattgtaatgtatacgatggatggatatgaaggaaaaacggtggataatcttaaaaaaagcgatttcgcgcagaaatcttatacagaaaaaagtttgatttcaacagaagcaaaagaagatacacccgtttataaattgattacagatgaaacgtggaatctgatgatcccagtttccaaaaaagaagcgtcaaaactttcagaaggaacgattcaggtaaaatttttaaaagataaaaaaacgcagaacggacagctttctattgtggatatagacggacagaaagtggcaaaaattactttgaaaaatggaatggttcgttatgcatcggagcgttttctgaaagtggaactggtaattcatacaaaaactggcttaaaaattcctcttagttccattgtagacaagaaattttatatcattccgtccgactatcttgcgaaagaagttcaggatggtgtagaaagagagggattttatagaattacgaaagatgacaaaggaaaagaaaaaaagacttttgtggttccggctatttataaaaatacggcagattcatcggataaaagtacaagtacggtaattaaaaagatagattactgttatgttgatatgcaaacctttcaagaaggtgatattgtacagaagccagattcttccgagacatttacagtgggagaaccggaatatctttctggcgcatactgcattaatcgtggctatgcaatgttccgttgtattgagcagatatcaggagaacaaaatgaagaatcttgtctgattaagaaaaatacagcttatggtctttcggaatatgacagaattgtaaaaaatggttcttctgtaaaagaagatgaaatactaacaggaaaacaaggagagtaaagaatgagtgtttatgaaaattacttagaagtagaaaaaaaagtacaggaagcatgtaaaagagcaggaagaaacagagaagaagtaaccttaattgcggttagtaagacaaaaccagtttctatgattgaagaacttcttcctcatggagtagtggactttggagaaaataaagtacaggaactgactgcaaaatacgaagtgcttccgaaagatttaaactggcatctcatcggtcatcttcagagaaataaggtaaaatatattattgataaagcttgcctgattcattctgtagattctattcgtctggccgaaacaatcagtcaggaagctgtgaaaaagaatgtgacagcatccattttagtagaagtcaatgttgcagaagaagaaagtaaatttggagttacttctgaggagacagaaaaattggtagaggaaatttcaaaactgccaaatatcgaagtcaaggggcttatgacaattgcaccatttgtagaaaattcagaagaaaatcgattagtttttagaaatttaagaaatttaagtgttgacatagccgctaaaaaatttaataatgttactatgaatgtcttaagcatgggcatgactggcgattatgaggtcgctatcgaagaaggtgcaacaatggtaagagttggtaccggaatcttcggagaaagagattacagcaaatagagattggagattttaacatgagtgtttttaataagcttttagatgcagtaaaaatgagtgatgattttgaacaagatggatttttagatgatgattttgatgaagatgaggatgaaatcaaagaagaaaaaccgagaaagcgttttttaaagaaattagaagaagaggatgaggcagaagaattagaagaagaaccggtagtggaaagacgaacacagaaaaagaaagcagaaaagaaacagccggagaagaaaacaacggagaaaccctctttctattcaagaaataccaaaaatacaaagacaaccgaaagctcttctaaagtaacaccaatgcgcactgcaaagagaaatccagctccggctgcaatggaggtctgcgtgattaaaccaaataatatggaagaaaccagagaaattgcagatactttaattgcaggatgtaccgttgtccttaatctggaaggaattgatgtcagtgtggcacaaagagtaattgatttttcatcaggaacctgctatgcaatgggaggaagtcttcagaaagtatccgactacatatttattctgactccatcaagtgtaggaattacaggtgattatcaggagattatagatggtgcgttcatgtcctctatccagacagaatattaattcggaaagagcataaaaatggagaaagaacagttatttgaaaaacgtatgatagagttaagtaagaatgcctattacagaggtattcttactttctctgattttttagatttaaatgaattacataagttgcatagtcttcctcttaaacagtatggtgtaaaagtggaaacttttggaggacatgcgtttgcagagcgtcagatggcagcatttatccctgatgcttttttctttagtcaggaatatccgatttcctgtatttgtattcgtccgtctatggaaaaatttgcagaaaatctgactcatcgggattatttgggagcaattttaaatcttggaattgagagaagtaaaatcggagatattttggtagaagataaaaaagcatacatcttttgccataattcgctgtgtgagtttttgatgaatgaaatctgccgtgtccggcataccacagtcgttccatctatcattgagaataaagaagagtttccgagtgtaaaacttcaaaaagtcacaggaacggtatcttctgtgagacttgacagcgttacggcgttggcattttcgacttcgagaagcagtattttaccattaatcgaagggaaaaagttatttgtaaatgggaaaaatattgtttcaaatgcctatcatttaaaagaaggagatattgtatccgtcagaggaaaaggaaaatatcgttttgatggaacaacaaatttaacgaagaaaaaccggtatcatgtagaagtttcgcgttattgctaaagtcaaaagagacagaaaggaacgaaaaaatgacagaaaatatattacaggtaaaaagaaatgatgaattttattatccgattgtatttcggaaaaactttgaagatttatcgaatcagttaaaaacattaaaattacaagaacgaaaatgctgcattgtaacggacagtaatgtggcaccgatttatttagagacagtaaaaaaagaactggaaaaagtttcggataccattatatccattattttaccggcaggagaggaaaataaaacgcttgcacagattcaaaatatttatgagaatttaatcaaagcacatttcgacagaaaagatttactttttgcattgggcggaggagttgttggagatatgaccggttttgcagcagcaacttatcttcgaggaattgattttatacagattccgaccacacttctggcacaggtagacagcagtattggaggaaaaacaggtgtcgacttcttacagtataaaaatatggttggagcatttcatcagccacgtctggtttatatgaatgtgcataccttagatacgctttcagatgaactattttcctgtggaatgggagaggttttaaagcatggattaattcgtgacctggattactttgaatggttaaaagaaaacagagaaaaggttcttaatttggacgaggatgctttgacagaaatgatttataaaagctgtgtcattaagaaaacagttgtagaaaacgatccgacagaaaaaggagaacgtgcagttttaaatatggggcatacagtaggtcatgcggtagaaaaattgaaaaatttcaaactgcttcatggacagtgtgtttctattgggacagtctgcgcatgttatttgtccttaaagagaggactcattacaaaagaagaatatgaatccgcattagaagcattaagagcatatcgtctgccgatttcggttcagggattaaatgcagatgagattttaacagcaacaaagtctgataaaaagatggagcaaggaaagattaagtttgttttacttgaaaaaatgggatatgcctatatcgacaagacggtaacagatgaagaaatgaaagaggcaattgaagtggttttagaagaatcgggagaagaaaagtcatgaaaatgaaaaagacaagaggtatcatttatttgcagttgattttgtcaactttcttcttaactgtgttagaccagtggacaaagcatcttgcagtcacgcatttgcaaaatcaatcagatatttcgttgattgatggagtattgtctctgcattatctcgaaaatcgtggtgctgcgtttggagtgtttcaaaatcggcagggtgctttttttattctgacggttgttattcttgcttttattttatatgtgttatggagaatgccggttacgaagaaatatttgccggttcgtattctttgttttttcctgacgtcaggagctcttggaaatttaatagaccgaatccgtcttaaatatgtgatagattttatttatttttccctgatagactttccggtatttaatgttgcagatatttatgtaactgtttcaatgattgtgttattattattggtgcttttttattataaagatgaggatgattttgcatttttaagtccaaaaaagaggggaaaatgataaatgaaaaaactttgcttacaggcagatgcatcagcagaaggacaacgaattgataaatatctggcagtggaactttcagattattcacgctcatttttgcagaagcagttaaaagagggaaatgtgacaatcggtgaaaaagcagtgaaaagcagttatcagctttcggaagaagaagaaattaccgtgttaattccagataacaaagaaccagatattgagccggagaatattccgttatcaatcctgtatgaggatgagcagcttttagtggtagataaaccaaaagggatggtggtacatccgagcgcgggtcattacagtggaacattagtaaatgcgttgttgtaccattgtaaggggaacctttccggaattaacggggtattaagaccaggaatcgttcatcgaattgataaggatacaacaggagcattattggtgtgtaaaacagatttggcacacagagatttagcacagcagttaaaagaacatagtatcacaagaaggtatcgtgcaattgtacatggaaatttaaaagaagaagagggaacaattgagggggcaattggacgtcatccgaccgaacgaaaaaagatggcgattaatctgaaaaacggaaaaccagcggtaacacattacaaagtgttagagcattataaaaattacagttatattgagtgtcggctggaaacaggaaggacgcatcagattcgtgttcacatgagcagtattggacatcctttggtgggagattttgtatatggtccgaaaaaatgtccattttcaaatctggagggtcagactctacatgcaatggtacttggatttgtacatcctgtcacaaaggagtatctggaatttacagcaccgcttccacaatattttgaaaaattacaaaaaaaactcatataatttatgcaaattttatatacaaaacaaaaaaaatagattataataaatataatcagaaacatcaagaaatatcaatggagaggagtgcatgaatatgacgaatcatacagttattacaatcggaagacagctcggaagtggtggtaaggaagtaggattgcagttggcagaagaacttggaattaaatgctatgataaagaacttttggaacgtgcagcaaaagacagtggattatgtcaggaattatttgaaaacaatgatgaaaaacctacaaatagtttcctgtattctctggtgatggatacatactcttttggatattcttcagcggcatttgcagatatgccaattaatcataaggtgtttttagctcagttcgatacgattaaaaatattgcaaaagaaggaccttgtgttattgtaggaagatgtgcggattatgcattatcagaatttgataatatgttaagtgtgtttgtccatgcagatttagaaaaaagaatccgtcgtgtggcacgaaaaaatgaattgacagatgcgactgcaaaggatcgtattcagaaaacagataaacgccgtgcaagctattataactattatacaagtaaaaaatggggcgatgctgcaagttataatctaagtttagatagtggagtattaggaattgacggctgtgttcaaatgattaaaaaagcaattgaaattaaagaagagcggctggcaaaaaataatcgtgaagtaaaataaaaattgggcagagggaaatctttttctctctgcctttttacgtgacgatttatttttttagaaatgtttcccagccatctaagtttccatttaaaattgcagtaaacatccgttcttttacaccaggatgttcatggtttaaagtacgaatcaattcttttacatattggcgtttggtataaccatccactggacagggacttttttccactggaaggtgatgtttatttttaaaaccaattacatccgcttcatttacaaagagtaaggggcggattacagtaagatctgttcggtcaagatgggttttcggagaaaatgtgtgaaaacgcccctcaaaaagcagagatagtaacattgtttcgataacatcatctttatgatgggcataagcaattttattacagcccgctttttttgcggcatcgtttaaggcaccttttctcatttttgcgcataaagaacaaggattgggttcttttcgttcattaaaaataatctgagcaatttctgtctgtacaatcgtataaggcacatttaattccctacagagcgcttttatttgtatgaggtcaaatccaggatgacctaaatcaatagtaatggcttctattgtaaaggaatttggataaaaacgttttaagccatttaaggcataaagaagggtaagactgtcttttcctcctgaaattccaactgctattttatctccggattcaattagattaaaggtatcaactgcctttctggtaagactcaataatctttgcagggtcatttatttcctccttagctatattttttctgtaaaagactataacacattggaaaaagaaaagaaatattttttacgaaattatgacacaaataataaatttcatgctataatataaacattaagcatttgcaaagagaataaatggaggaaatatatgaagtttcgttgggataaaaagtatttatattggggggtgacaggctttgcagtcatttgtgccagtctgcttttttattttggactgtttcacatggatgtgctatggggaaaagttcataatctgtttactgttttaatgccggttgtctggggtgtaattattgcatatttattaacaccgattgtaaatatattggaaaaaaaggtatttttttcgttattagaacattttcatgttgaacttacaaaaaagaaacgtgtgttaattcgctatctgggaatttttatttcccttatattggcatgtctggctatttattctttatttgcaatgattgtgccgtctattgtagaaagtattatcagtattgtaaatgattcaccaagatacattcagaatattatgaattggctgagttccattttaagagataatgaagaacttcagacgaccgtgtttaattttattgataattattcatttaaagtagaaaattggatgaatcagcagctgcttcctcagcttcgtcagattttacagcagatgacaacaggaatttttggcgcagttttgtttgtaaaaaatattttaatcggagcgattatttcgatttacctgatggcatcaaaagagacttatctttctgagggaaagatgtttatctatgctatttttgatacagagagagcaaattctattatcaaagcatgtcgttatacgaatcgtgtatttatgggttttatcagcggaaaaattattgattctgcaatcattggtgttttatgttatattattacttctattttgggaacaccttatgcagtgcttgtcagcgtaattgtgggtgtcacaaatattattccgttttttggaccatatttgggagctattccaagtgcatttattattttgctggtaaatccgatgcagtgtttatatttcctgattgcaattttattgttgcagcagtttgatggaaatatattaggaccaaagattttaggggaatcgacaggtttgtccagctttatggttattgttgcaattcttttatttggtggatttatgggaatttcaggcatgattatcggagttccggtatgggcggttatctgtacaggaatccgtcagcttcgagaatatttcctgaaagagaaacatctaccggttgaagatgaactttacatggatattgagtccattgaccctgaaagccatacgattattaaattaaaaaaagaagatttaaaggaacaacaaagagaaagcaaagaacatacgaaagagaaaaatatagagaagggaaacgagtaataaatgaaatttgtaatccagaaagtaagtcaggcctctgtttctgtggaggggaattgcgttggaaaaatccaaaagggatttctggtatttgtaggaattggaaaagaagatacaaaggaaattgcagatcagtatattaagaaaatggtacaactgcgaatttttcaggatgaaaatggaaaaacaaatttatctttgacggatgtcgggggtgaagtactgattatttctcagtttacactatatgcgaactgtagaaagggaaatcggccaagtttttttgatgccggagagcctcaaatggcagaagaactatataaatatattatcaaaaaaacgaaagaaacgatttcggtggtggagtcaggagaatttggagcaatgatgcaggtatctctggtaaatgaaggtccatttacaattgtttttgatgagaatacatttcgctgacagaggggaattcattcgtgaaaaataagagattattacaaagtaaattattggcagtaactttgagtgcagctgttcttttaggacagtcaacagttatggcggcagagcttccatctgttgaggacatggaagcaacaaaagagttcaaacaggaatcggatttatctttggaaaaagataagtccgatagttctgtagagaatagagagaaaaaagaaaatactgaagaagaacaagaaccagaaaaaaaagaatttgatggaggacaagatggtattaatttggactccaaagatggttcggaaaatgattcagaaaatgattccgaagataattcaggggatagcgcagagagtaatccggaagagaaagaacgggatgcagatgatgatgataaggaaaatgaaacttcagatgatacaagtgcggctgattcagcacaaaataaagatatagaagaagaaccaaaagaaacagaaaaaattcaattagaagaacagatagaacaagatctgcaggtacaggaagcttcttatggatggaataaacagggcagtaactggtattatataaatcctcagacgaaaaccaaagtttctggctggcagaagatatctggaaaatggttttatttctcttcggctggctggatgcagattggctggcagaaagttcggggaaaatggtattaccttggaaatgccaatgatggttcaatgaaaaaagggttgcaaaaaatacatggcaagtggtattatttttcagatgatggagcaatgcagagcggatggcaaaaaatatctggaaaatggtattattttggagacgcagaagatggctctatgaaaacttattggcagaaagtgtccggaagatactactggcttggtcatggaaatgatggagccatgaaaacaggctggcagaaagtttggggaaagtggttttaccttgcagagaatggagaaatgcagacaggatggaaaaaactgtctggtaagtggtactatcttggcggttctaatgatggttcaatgaaatatgattggcaaaaaatttcaggtcggtggtattatctgggtggggcggatgatggagttatgcgtacatactggcatcaggtgagaggaaaatattactggcttggaagaaatggtgctatgagagatggttggcagagagtctggggaaaatggtattaccttggaagttctggtgatggctcgatgaagagtggctggcagagagtatctggaaaatggtattatcttggaacatccagtgatggagtcatgaaaacaggttggcagacgattaataaaaagaaatattatttttatccggatggtagtatggcaagcaactgtacaatagatggttattacattaatagtaacggtgaaaagagtgactcaaacagtacgttaaatacctgggtgtttccgtgtccgtctattacttatgtatcaagtgaatttggatatcgggaaagccctggtggaatcggctctacgaatcacaagggagtagatatggcagcaccggcaaattcccgtgttttagctgttgcagcaggtacggtggttgcttctggctatggatttaatggagagggaaattacgcagaaatagaccatggaaatgggattcatacaatttatatgcatttaatagcaagtccggttgtaaaaaaaggaagtacagtaaaagccggacaggtgattggttatgtaggaatgactggagcagcgacgggatatcatttacattttggggtgaaggtaaatggaacttatgttaatccgtggaattatttaaaacgtccaagcggaatgtaattgaaaagaagaaaggtttttgatttatgaaaaatagaggaaaaatggttacaaagttgtgtggatttgttatgagtgcatcattgttgatgaatcaggcagtttatgcttctggagagatagcaggtgaaacactttcaggagaagtacagagtgcggaagttcaagaagaaataatgaattcaagtgaaaccttaccgaagatatcccaagatttatccgaagctgaaaatgaagctgaaacagagggagctgaaactgaaacagaaactacagattcagaggcagaatcaaaagaagaagtaagtcagaaagaagaagtgagtcgggatgaaaagaatcaagatgaaacttctgatgaaaattctgatgaaaattctaaagaagaggcattaggagaatcacaagagacaggaaatactattcaaggagagcagcaggcaacactggccggaccaaaaaagacgggctgggttacagaaaatgggaaagaatattattatgacgaagagggtaaaccttatacaaaaagccgtattttagatttaaatggaactctttactatataaattccaatggtgaactgcggacacaggtgggctgggtaaaagatggtgcaaactggtattatgtaacatctcaaaaagcacttgcaaaaaatggctggataaaatctggaagcaattggttttatttaaacagcgatggtgtaatgcagaccggaatgattacggtatatggaaagaaatacatccttcaagagtctggagcaatgttaaagaaaacaggctgggtgcaatatcaagggaaccggtattacatgtatagcgacggacatgtgtttcatggaggatggttaaaggtctctaataagtggtattacatggatacagaaaccggaatgatgaaaaaaggctggcttaaaacctctggaaaatattattatttaaatagttcaggagtgatgcagaccggctgggtaaaatccggaagttgctggtattatatgaatacttctggtatcatgcagacaggctggcttaagtctggaaaaagctggtattacttaagtgcatcctctggagcaatgcagaccggaatgattacagtatatggaaagaactatattcttcaggattccggagtcatgttaagcaaaacaggttgggtgcaatatcagggaaattggtattatatgtatagcgacggacatgtgtttcatggaggatggttaaaggtctctaataagtggtattacatggatacagaaaccggaatgatgaaaaaaggctggcttaaaacttctggaaaatactattatttaaacagttcgggagtgatgcagaccggctgggtaaaatccggaaattactggtactatatgaatacttctggtatcatgcagaccggtccgattaaagtaggtggtagctggtattacttaaatccgtcatcaggagcaatgcagaccggatggatggaagcggatggaaagaaatactatgtaaaaccatccggtcaaattagcattggctgggtggggattaataatgtttggtattattttaattcaaccggagaaatgcagactggatggcagaaggtaaaagaagaagaagaatggtactatctggacaagacaacaggagcaatgaaaaaaggctggtttgaagacggtgatagctggtattatttaaatgcttctggaaaaatggtaaccggctggcagatagttggtggagaacgttattacatgaatagtgatggagtgatgcagacaggctggttggaaatgggagataagagctattatctgcagagcagtggtgcaatggcaactggaatcctaacaattgacggagtaaaattcaaattcagcgataatggtgagctgattggttctatcagcgaagagggagtaggcgcagatattgtggcttatgcacgtcagtttgttgggaatccttatgtatatggcggtacaagcctgacaaatggagcagactgctccggatttgttcagagtatctataagaaatttggaattacagtaagacgtaccagttatgagcaggagagagatggaagaccgattacaagacaggaattacagccgggagatttggtgttttattatagcgactattctcatgtagcaatttatataggagatgaccagattattcatgctgcaaatcgttcaaaaggcatcacaatttctcggattaattataatggaaatccgacagcatatagaagatactggtaaataaaaaaagaatcccttttatccgtttcgctatatctatggttgaaatttaagataaaagggatatgttattaaaaaatataatgttatagtatgaatattatatataacaaaaacaaacccctttacacacaaaaaaagaaaggagcttccacatggataacaaaaacgataaaaatcacttctttgaccccgaaatgcaaagtatttggaaacattttgtttctcacttcagaaaccaaaacagtgcagcatcttatcgaagtgataccatcgaatttttggaatttaccgaaaaaagttttcttgaaacaacagcttctgacgtggaaaattactacgccattcagcaaaaaaaaataaatgaaaaagaattacagcctagtacagttgccaaaaagataagagaattaaattcattatcaacatatatcgaagaaaataaagaatattatcatataaaagacaattaccaaaatcattttgcggcgtatctgcctcatattgaaaaaatgagtaaatttgctcattctgttccgatagaagatattgataagctgttaattgcagctcaacccgattatatggtttactgtattattacattgttatatcgaatgggattatcgtcaacggagatagtagagcttatgccagaacattttacgatttatgataatggtgtatatctaaggataccaaaacgacgagaaacctgttttgtaccggaagatgtctataaaattatagaaaaatacttatcacagagaatagaaaataaataccttttctataacagcagaggaacaaaattaaatacaatgtatatcagtcgtatgatgaaaaaatatacgacactggctggaattccatcgtacagtgcagaaagtcttagaaattcatgcgcttacacaatgtttgcttatgatgcgaaaccagaacaggtagcaagagaaatgggagttacagaaagccagattcgtcgttataagaatatgaattatatggatactacttcaagagcaattcgtggactggtaaaattaaaagcagaaccaccagaataacataaaattatattatgtaaactgtaaagcaccgaatccaagataatcagatattaacaatcgaaacccctactgccaataacaacaatgataaaaaagacccgaagctagttaactttaggtcttttttgcatactatataaatactatatgtagtgaattgcaatatccatttgactcattgtaaatttccattacggatgacatttctgacacgcttcatatccctggtctaacaaatcctgtctatttccggtatatttcttacgattttccggattcatttgttttgcacttggacagtcctgcgtatgaaatttcattgtattttcatttaaaatgtaagtcgtttcatttgaggcagaagtattattagatgtactgtctgtagataaataactatctcccgtggcataatcaatagtaatatccggttgtacattataacaatagacattaaataaaatgccatcaccattatcttcaacggacatagcttccatttctactccagatgcaaccaaattgtcacccttgaaaataggagtaacacggtataacacatgatagtcagtttcttttacataatccgcaatcatattttcaaatgggagcatcccatcaacgttcatatatctggtaccggtaatcaaattcttttcatttgcattttcaccggctaactgccagccaatcaaatgacaacggttatataaagatttcccatctacattatcatatcttacagagtgccatccggttggcttgacctgactgatagaaccacgttcctcggttggcattaaatcaatacagatatttgcataagcaactccgcatcttcctaactcatctaaatcactataattttcaaatggttcttcggttaaatctgcatctgtaaaaaatggctgattatcattaattacaacataaggtttaccggaatattccggtatagaatccaattgaatatttttttcatctgagctaacactgatatctgaaggactgctttgtacagttgtctgactgctttcagaagtaattcctaagtttccctcaacgtcacagcctgtcattaaaaacatcaggcagagtagaagagtaagccattttaattgttttttcatagttttccctcgatttctattcttctgccagttcttcagcaagagatttcttaattttctttctggttacctctacaatgtttaattttgtaatatctaccacatttccctttactgggtcttcatttaaataacgctgaagtacatgcatcagttcttttttatcttcttctctttttaaattaataaaatcaatcaaaatcatgccggaaagattacgcatacgaagctgtcttgcaatttcgcctgctgcctcaagattaatttttcgataagtttcctgtacttctttctttccggtatattttccggtatttacatcaattgaaacgaaggcctctgtctgttgaatcaccagaaatccaccagactttaaccagactttttcagaaagtgcctcttttaacgctttctcaattgaataaactttacaaagcggaagtaaatcatcctgataaaaacgtaatttctttgcttctattccatagtgctctaaatagatttgaatcgtttcaaatagttctttgtcgtccgtgacaatttcttccagctcatctgcatacaaattttgaagaacctgaagatatggcggcatggaaataaaaagttttgaaaaacaggttctcattccagattttttttgaatttctttcaattgaccataaagcttgtctaattcttctaaaatctcaccgccttctgcatgagcactgtttgtacgaagaatgactccagcatcttctggaagatgagcttgtaaaagttctcttaattcctgttttctctgtgcttttaattttccggaaaagccaagcggttcaaattttgaagtcaaaacaacataacgccctgccagatttaaatcacaggttacgcaagggagtttgccgcgaatcggctctcggcacacctgtactaaaagttcgtctccaatacaaactcgattattttttttctgatttacaaaaaatggctctgctttttcctctaaggaataataacagataattccattttcaatttcaataaaagccgcacgaatgttttcggcaatattttttacttttccaatataaatatttccaagaatagatgcttcctcttttttataaaggtcaagctgacagattttatagccgatatcaagtgctacgacaattttttcttttcctttgacatgcataggagtgataattaatttactcaatttcttctcctaaatcctctaaggaaaccagatttcttgcttcgtcactaccagtatctgcataaagctcacaacgatgaatcataaattttagattctcataagaaatctccataaatgccgcaaatgcttccatcacaagttctggttttgtattattggagctgcctgctgcaagctgcataaaaatttcatccttttcttctaaagaaagtttataaataaatggacgaatatctaattctttttcactttttttcgttttctttaaaataacaatttctttttgtgctttaaattcttctaatttctctttccagttctctggaagttttgcagtttcacggaattttagacgataatctgctgctgcaaccagcgacatggctttggaagctttaccatcctctacctggcggatgcttaaaatcttcatcccttctgccattgcatcatttaagcgttttaccatatcagaagaagtcgttgcactttttaattccatatcgaagtattcaccggtacttgtaattccaactccgagaggtgaggcaaatgacataatcatatgtggactgaatccttctgaaaatgcgacatctaaattggcacgtttgactgccttttgaaaatagcgcataatatccagatgaccgataaatttcatagccccttcttttgcaaattttaccctaaccttcaacgcatacccctcctttgtattttcctgcaccacagccggaacatttcatacggcagtttggcgttactgtttcttccattgctgttttccattctctttgtaaaaatttctttgttacgccggcattgatgaagtcccatggcagaagttcatcaagcggacgctgtcttagagtataaaattcagggtcaatatttaattcttcaaatgcttccatccataaatcatagcggaaatattcggaccatgcatcaaagagagcaccctttctataagcaagctctaacacatcggcaactttacggtcacctcttgctaaaattccttctaataccgtaacatctgcttcgtgatagttatatttaatactcttttgatttaactgggcacgaatttctgattttacgattttagcacgttcaagatattcttcttttttacacatcgaagcccactgaaatggggtaaatggttttggaacaaagaaagacgtacttaccacaatctgacatcttccatgacgttggtcttttggaatttcataatatttttttgcaacttcttctgccagatgcgcaattcctttcatatcttcttccgtttctgttggaagtcctaacataaaatagagttttacacgagaccagccaccctgaaaggctttaaaagagccatttaaaatatcttcctgagtcagacctttattaattacattacgcattctctgtgttcctgcttccggtgcaaaggtcagactgctctttttgatatcctgtactttactcataacatccaaagaaaaagcgtcaatacgaagcgatggaagcgaaatatttacattacgctcggaacactcttcaattaaaaagtcaattagctctggaagcttggaataatcactggagcttaaagaactaagagaaatttcctcatgtcccgtactttccagcatttcttttgcggtttcctttaaaaatgctacgtttttctcacgggtcggacgataaatcatacctgcctgacaaaaacggcatccccggatacaacccctctggatttccagtgtaacacggtcctgagttgccttaataaatggcacaacaggtttctttggataacagacattgacaaaatccataacgacctgtttatcaatcgtttcttttgcatgttcattatttggatgaaatgctgcaagtgttccatcctcgttgtattcggcatcataaaatgccggaacatataaccctggaatttctgctgccttttccaaaaattcttttctgctctttccggagtttttccagattttatattcatctaacagttcatcaaatacagtttccccttctccgatataaaaaatatcaaaaaattttgccagcggttctggattgtacgcacaaggtccgccacccatcacgattgggtcatcttcacttcgatcagaagcatgaagcggaatctggcttaagtctaaaatctgaaggatattggtatagcacatttcatactgtatagtaataccaaggaaatcaaaatctttaatgttatcttgcgattcaagcgcaaaaagtggaatattttctttccgcataatggcatctaagtccggccatggggaataaacgcgctcgcaccaggtatcctcgcgtctattgaacatatcatataaaatctgaattccgagatgggacattccgatttcgtagacatccgggaagcacatcgcaaatcgaatgtctacctcatttttgtttttcattactgaattgatttcattcccgatatagcgggctggcttctcgatttctagtaatatttcatcacttaatgctagttttctcaatttttacctctttctttttgtgcaaagcgtataagctttaacccactcacaatgcgttgcacgttttcttacctctttttgtttttacttaaattttgagcatttttataaatttcttacactttttttgaatccatttacactcctatctagtgccgaaacaaatagataacaggagtggtatgtacatctttagtgtaattttccttacaagtatatagtaatacttgaatttgttcaaccaaataaattggaaaatctctttttttgccggttttatgttcttttttgccatttcaagtctttttattctttatttttaagtagtgtcatcattcccagaaccgccggaattatcagaagcagggttatccacacactctggaacaataaccaggaaagaattgaaaagataacgaaaataattagtttcatccatgcatctacctgcagttttcttttttggaacaggaggcaggaactaaccagggtaaccaggcagactaagaataaaataaaaatccctgctgctagaagaaatgcaattactccagtcagaccgccaagcatagtagtgaaaactcccgaaaggactaaatgaccgccgatgtaatcagacatggtttctgattcagaaattatatgtgctccagccgttgttatatttttcgcataaaacagaaatatagcaattcttgcttctacgattgcaaggaatagggtatatattccaataagtaatgttgaaagccaggctgttggtggcagtttttctttttcctgcatagtgaatcatcctgtctgctttatataatcttatagcgttttaaatacttttcattttgaacttgaatgtctttgtattctgtcagcaaattgtagaaggttgcttttttaagtcctgatttttcaataaattgttttgatgagatttccccattcctccatttttcatatagttcatcccagttatctgggaacggcaatttatttcttcctgaatttgctcttttaaaagaaacagtaactacattcttattatcacttaatattgattccaatatcgtatttaaaacagcttgattcattggctgtgttactccaaattcataagtagatgtaacatcacagataacaagttttacagaattatcaataaaccatgaaagctgggcagcaatatcggcatcatttagtccaagagaatttagggaagaaacaacaaagatggtatggtcgtcaatcttttttatctcattgaatgatgtaaaagaccttttattttcacttgtaaccagcaattcatcctgctcttttttgattgcttttattacattatcaaaaatagataagggttcatgtaattttacatataaatgtatcgtcaataaaatcattcctttccaaatagtgaaaatttactaagtttatgtccacatcttttttcaaatacttttctatcgattgaaattttgcagtattcacgggtaaacaatatttccgctttcatttcagccggaagtaaatttttccatgaattaatttttctctgactatctttatctatcccacattcaatcaataatctgtcttttgtaagtttataagctttcttgttatttttacaaaaagaagcaatctcgtgtacaatttcatccgcattagaatccatagaataatcatcattccaggttaactttcttataatatgaaggcaacgtataaccataatcctcaaaaatagaaatgattacttcagatgatagagccaaaagttttgggtaataatcgtctggaaattcttttgagtaaataataaaatccaattcctcttttgccttatccatcattttgctcaaatattctcggtaaaacccagtgcctagttttcttataatcgattttcctctgcttgcataagctgttttatctattgtacttggcaatgctccatccatcgcaaaaaatatcattcgttttctaagaggctcatctggtttcagaacatcattacttgcaaataaaatcataggcatatcttcgagttgattttcttcacatttttcggggttcttaataatatctttgattcgagagatgtataggttatctatttcatcaataaaaaaagggactcccttcactgcaagttgtgtctctctgatattatctttcgaatagtcacaagcttttgttccatctaattctttgccagtcattaattttaatgcagcttttatcataaatgtctttccactattagatgtttctgatgatataagtgcaaacaaaggcaaggagtctgtcgacactccttttattttggaggcacatctaaattttgcatgaaacggtgagcaaaaaattgcattcattaatttataatgtgtatatttaagtttttctatgtcagatgaaacaaactgttcaaaattatgaaatatcccaattatttcattgatatcgtgctttacttcttcatctgtaggattcaaatgaagttgtttaccattaagaaaagcttctccatgatataaatccaaagtcaaagaaggatatcgctctgttatattacgtgttttcattttcttttgcaataatttcttttgattatattccattttttcaagtgttttgggcacaatttcaaacagccctgttttcgattttggttttacatcccctaaaagggcttgatatttttctttgattgctccgtggtctatggtatatttaatattgtcgaatgatatgtcaccttctggctgttgtaatacaattgcatgacctgtttctttaatgccttttaaaataacattctcttcaaccaagttatctgttttctttgatgaaatcacatccattgtaattgcttgtgatatatcccaagctgtttcaaaatcctttacatacgcttcgtaacattctttcgaatcatcgtattcataatgttctatatggtcattattccatgcttttttcgaaagatttgcagatgctttaatgactcgtgttctgccattatctgattttaataaataaatttttctatggtctaatacaaaagatggagttttaaattcaatatcaccgtctgtaagcatgtttgctaatttatcatacttctggatggctttgcctgcttcataagcatttgttaaaacttctgctaataaatcatttaatttcccatctttttgaacaagaaaattaccacctagaattacttctccataatcgaaatgttccatcaactcattgatgaaaccgatatcataagaaaacgtaattgccttaatcatattaaatcctgaaaataaatctttcaaggtcatatattctacggattgtaattctgatttaaaacattttaagagctcatcatctttcgtactgattccctcaattactgaaaaggcatcatttgcaaacaagttcatttgtccatccataataggttctccttgtctaaaaataaattgtattttttagactattatatcttgcgtctaaaattaaatcaatatttttggacaaaaaaatttcatttcttttataagaataacttttccatgtataagcatgtataaatttatacttttcccattcgattcttaattttttcttataatttttcggagtataatataaaaaacggggtattttatgttagatgttctttggtaataatgtgtaaaaattgacggttttaggattgtttgatatactatttactgtgtcggtttatgtgtctatttttataataaatttgacacacatttttaaataattgaatttttatgtttgtatgtacttgctaaaataaaaataataggaggattggtatggcaaaaattcttttccttatggatgatacaacgcacattgataaaacagaattgctaaacaagaaatataacacaaatggaatttcagattttcttaataaagaatttgaaaggcaaaaagcagagaataacagcctggtagaagttatagatgctgattttttagaggtattacacaacaattatgaagcagactgtttctattcagaaagacttccagagggagtcattggttcttatgctgattttgccaaagattttgatgattttcatgactggcagaatcaacttttgtatgattttgcaaaagcggatacagatgtagttttagcgggaaattttattttcttccgtttttcaaaggagcagaaagagaaatggttttccaataaatatgaggaatttcctaaaattgttgcaacagtaactgctgagaattttcatgaatttgcgaccatcaacaaattgcaggaaaccatttcttccagtaactctattgtgtcttatgtcatggatggaatgagtgatattcatcgatttgatgatatgattcgtatgattgactctaatgagtggtatgtcattgaaaatgcaatcaagctttcttttgacgaagaaaaataaactatcatttacagttattattcaattacagaaccccatctttctatataaaacagacagacggggttcttatatttgttttattatttagctattgttttattcgttaattatatcaatctgacacattttcattgtttccagtgctgatttatgagtttgtggtgtgacaccagcgcagcaggatgcatctactgtaatctttaattctggaaaaacagcctttaaaatcaatgcattggatactacacagatgtcagtacaaagtccgattaattcaatctcattgtcaaatttctgctcttcccagtgagaccagccaaatgttggcttatcaatgtatgtagctccttctacttctaattcttccgctatctgccatccatgcgtaccataaatacaatgttccactggcaatttcttaccttctggagtattcagatagtcgatttggtgggtatccctcgtaaaaataatgttatctccacgtttttgatattctttaattttttcttttactgtcggaacaattgtctgtgcttcttttgtgccgaggcttccatcgataaaatcattctgcatatctattacaattaatactttgttcatttttttattccttttctaaatttttttaacatttatttaagtatacaattctttaatagatttgacaagttactgctttctatgcaaaaataagaaaaacagaagggggtatttattatagaagttattcttactttagaaaataggaatgggatgctttttaatcatcgtagattaagtcgtgataggagagtttgcgaaaaaattttagattattcaaacgagaaagaattatggatgaatgcttattcacgaaaattatttacagatttaacagatatcaatagtattcaagttgacgaagaatttttagacaaatcacaatctatttgttttgtagaaaatcaagatattacgccttatctgcctaaaatcgatacgcttgttctttttcaatggaatcgtgactatccggcggatttcttttttacagtagatttatcacaatggaatttaatttctacagaagactttgagggaacatctcatgagaagattacaatggaggtatacaaaaaagatttatgaaatccatgcttacaacgctttgctatattgaaaaagaagaccgttatcttatgcttcaccgcatatccaagaaaaatgacgtcaataaagaaaaatggataggtgtcggaggacattttgaaaaagatgagagtccggaggactgtctgttaagggaagtaaaagaagaaacaggtcttgctctgacttcttatcatttccgcggaattgtaacatttatattaaaggataagggttctgaattaacggaatacatgtgcctgtataccgcagatgactatgaaggaacactttgtgactgcaatgagggagtcttaaaatgggtcgataagaacgaaatctttaacttaaatctttgggaaggagaccggatttttttgagattattacaggagaatcatccatttttttcattaaagctggtttatgaagggaactgtttaaaagaggcagtacttgacggaaaaagaatttagaaaaaaaatgtattttttcagcaaaagatattgacgaatttaaaaaagcgtgctaagatattcgagtatgccgcacagagaggttttaagcactgtgaaaaagtcagtcaccatattctggcgagtaatgataataggaggtgccatatgtacgcaattattgcaacaggtggtaaacagtacaaagtagccgaaggcgatgttatcagagtagaaaaacttggagcagaagctggcgaaactgttacatttgaccaggttcttgctgtaaacaacgatggtttaaaagttggcgaagatgttgctaatgcatctgtaactgcatctgtagttgaaaacggtaaagcaaaaaaagttatcgtttacaaatataagagaaaaaccggataccacaagaaaaacggtcatagacagcagtttaccaaagttaaaatcgaaaaaatcaacgcttaattatgacaaaagttacattttatcaaaaaaatggtgttgtaattggatttgacgcatgggatcatgcgggatatgcaaatgcaggtgaagacattatctgtgcagcggtatccgcccttgtcttaaatgcaatcaattccatcgaagcttttacctcggatgcatttacagcagatgtaaaagaagaggatggacggattgaatttcgactggagcaggataacccctctgatgatacaaccctgctgctgaagtctctaatcttaggacttcagggaatagagaatgaagaagaaaatatgcaatatattgatgttatattcgaggaggtgtaaggcatgttaagaatgaaccttcagtttttcgctcataaaaaaggtgttggttctactaagaatggtagagattccgaatccaagagactgggcgctaaaagagcagacggacagtttgtaaaagccggaaacattctttacagacagcgtggaacaaaaattcatccaggtgtgaatgttggacgcggtggagacgatacattatttgcattagtagatggtgttgttcgttttgaaagaaaaggcagagataaaaaacaggtttctgttgttccagtaactgcagaataagttttaaaaatgaggcttcaaatcgttcaggtttgaagccactttttatatattggtaaacgtaggaaaagtggacttgtccactttattttatatagattataaagaaagatagaggttattatgtttgcagatagagcaaagattattatccgctcaggaaaaggcggagatggtcatgtaagcttccgtagagaactctatgtcccaaatggcggaccagacggcggtgacggaggacgaggcggagatgtcatttttgaagtggataaaggcctcaatgcccttacggactatcgacataaaagaaaatatgccgcagaaaacggacaggaaggtggaaaaaaacgctgtcacggtgcggatggaaaagatattgttttaaaagttccagaaggaacggtaatcaaagaagcaacttccggtaaagtcattgcagatatgtctggcgaaaatcagcgtcagattgtattaaaaggcggacgtggcggaaaaggaaatatgcattatgcgacagctaccatgcaggttccgaaatatgcccagccaggacagccggcacaggaattagaagttcagttagaattaaaagtaattgctgatgtcggacttttaggatttccaaatgtaggcaaatctaccttcctttcaagagtcagcaatgcaagaccacagattgccaattatcattttacgactttaaatccgcaccttggagtggttgatttagacgattgcaatggatttgttatcgcagatattccaggactgattgaaggagcttccgaaggagtcggacttggtcatcagttcttgcgtcacattgaacgttgtcgtgtcttgattcatttagtagatgcagcttctacagaaggacgtgacccaatagacgatatttacaaaatcaacaaagaattagaagcttatgacccaaaattaaaagaagttccacaggtcattgcagcaaataaaattgatgcaatttattcggaggacgaagaccctgtagaaaaaatccgtcaggaatttgaaccacagggaatcaaagtatttgcaatttccgcagtatccggaaaaggagtaaaagagctgttatattatgtaaaaggactgcttgataccattgagaaagagccggttgtctttgaacaggaattcttcccggaagatatgttaatcacagaaaatcttccttatactgtttatcaggatgaagaggacgagcatttattccatatggaaggaccgaagattgaaaaaatgctgggttataccaacttagattccgaaaaaggtttctctttcttccaacgtttcttaaaagacagtggtatcttagaagacttagaaaaagccggaattcaggaaggcgataccgtccgtatgtatggatttgattttgattattataaataaaaaccagaaaggggaagataatatgacaagtaaacagcgtgcttatttaaaaagtctggctatgacgatggacccgattttacagattgggaaagcaagcctgactcctgaaaatacagcatccgttgcagaagcacttgaagccagagaactgattaaaatcaatgttcttcaaaactgcatggatgacccgaaagaaatcgctcaggtattagcagaacgtacgaaatcacaggttgttcaggtaatcggaaagaaaattgtcctttataaagagggcaaaaaagaaaagaaaaaaatcgtacttccaaaataattaaaacagaacacggttttggttttgtatctgccagaatcagattagataagaggcaaattatggataaacaaaaaaaacgaatcggcattatgggtggaacatttgacccgattcatatcggtcatctgatattaggagagaccgcttatgagcagtttcaattagatgaagtgctgtttatgccatctggaaatccacctcataaacgaaaccgagcacaccgtgcaacggatgaccaaagatgcgaaatggtaaaacgtgcgattgcttccaatcctcatttttctctttctttagaggaaatgaacgaagatggttttacttatacctatcgtactttggaacgcttaaataaaaaacatccaaatacggaatattattttattttaggtgcagattctctttttgattttgatgaatggaaagaacctgcacgaatctgtcaggccggcattattgtagttgcaaccagaaatcataccaaagaggaagcgttagatgagacgatttcttatctgacaaaaaaatacaatggtagttttaaaaagctgaaaaccttaaatattgacatttcttccgctttactgcgttcctgggtcgcaggtaaaagaaatatccgctattatattcctgacagcgtaattgagtacatcaaacaaaaccatatctacgaggaatgtgatgaacatgcaatatgatttaaaagcatttgcaaaaaaagtgaaaaagcatcaagaaaaagagcgttatgaacatacaaaaggagttatgtatacagcagccgcactggcaatggcttatggctgtgatttagaaaaagccagagttgcaggactgctacatgactgtgcaaagtgtataccggacgaaaaaaaaataaaactttgcgagaaaaataagatagaaatttcagaaattgaagctcaggctccttttcttttacatgctaaattaggagcgtttcttgcaaaagaaaaatatcaggtagaagaggaagagattctttcttctattcgctggcatacaaccggaaaagcagatatgacgatgctggaaaaaattatttacattgcggattatattgagccaaacagagagaaagctccaaatcttgccaaaatccgccaaactgctttttatgatattgatgaatgtatgtatgagattttgcgggataccttagagtatcttggaaaaaatcctaaaacactcgatcctgaaacgaaagatgcatttgaattttatagacagttacatgaaacaaagcaacaagaaaaaaaggagagcgctttatgacaagcaaagaacttgcaaaattagcctgtgatgcattagacgataaaaaagcacttgaaattaaagttatcaacattgaaaacgtatctacccttgcagattatttcattatcgcaagcggaacaaaccataatcaggttcaggcgatggccgacaacgtggatgaaacactcggaagagccggatatgaaccgaaacaaattgaaggatatcagaatgcaaactggattctgatggattacagagatatcgtgattcatatcttcgatgaagaaaaccgtttattttatgatttagaaagaatctggagagatggtactgttgttgaagtagaagatttaaaataaaaattaatcaaaagccctgagaaatctattttactttctcaaggcttttttgttatactttatctagttagcagctacttaatttacgctgtactagtagagttacatctcttaaaagataaaagccaaagtataagaacaaaggagaaacaacgctatggaatttgataaaaatctgattctgtatggtcctccaggaacaggaaaaacatactataccatactttatgccgttgcaatctgcgaagaaaaaaatttagatgaaatagaagcacttccttacgaacaggtactaaaacgctatcaggaattaaaggcgaaagaaaaaaggattgcctttactacctttcatcaatcgtatggttatgaagaatttatcgaaggaatccgtccgaatctaaatcacgattccaatgatgtggaatatacgataaaagatgggatatttaaagcattttgtgggagggcagaacaaaaaaaggcagagacaaagaaaacaaaaattagaaatgaagctcgtgtctggaatgtcattctcggtggaacggaatatccagagttaaagaaaaaatgttttgaggagggaacgattcgaatcggctgggatggaagtccggaaatcatcaccgaagataccggaaatttaaatgataaagaacgtcgaatcttacttaattttcatcaggaaatggaaatcggtgatattgtggtggcacgttccacagcaagtgcggtagatggaattggagtgataaccagcaatgcagaatttgatacttctattgagagatatccaagaaaacgtatggtaaactggatttgtaaaggtaaagatatcgaaatcattgatttaaatggtggtgtcagactcgacagaaaatcagtatacgaattagtaaggattcatgtgggagatttattaagcaaaattccagcagattctgacattgagttaaaagaagaaacacgaccttatgtatttattatggatgaaattaatcgtggaaatatctccaaaatttttggtgaactgattactttgattgaaccggtaaaacgaaaaggagcaaaagaagcaatggaagttattctgccatattccaacaagtcatttggcgtgccaaataatgtgtatctgattggaacaatgaatactgccgaccgttcgatttcacttatggatactgcacttcgccgccgatttcagtttattgagaggatgcctgatgttacagtccttagaaaaatgggcgcagataaaattcgtgtagaaggagtagaacttgatgtggcacttatgctggaatgtatgaacaaacgcattgaatttttatttgaccgagaacacacgattggacatgctttttttcttggtttaaaagatgaaacgacgataacaaaactggctgatatctttaagaaatctatcattcccctgcttcaggaatatttttatgaagattacagcaaaattatgcttgtacttggagacaatggaaaaacgcaggatgcacacaaatttattcttgaaacaagaacaactgcaactactatttttagaggcgatacatccgattttgatattcctgagtattcttatcagattcaagattctgcgttttttaatattaacagttatattgaaattatgggtgataagaaattggagaatgtatgatgcaggttctggaagtacgagaatttgaaaaaatcattgaagcaaatgagaaaaatcaaaacttaaaaaggtttgataagcaataccaatgccttgataaaaagacatttcatgagtttcttgaatttattcatgagtttgagcaaaaagaagaaaactcagatattttaaacttcataaccattggatataagaaagcactcggtcagacaatcacattcaaaaactacgttgggctgattcagctaaaaaagaatgttcagatacagattcttcctaaaattgcatttttaaaagaagaaaaagatgaaacaaagaaagtattcttaaaaatgcttcgcagtatgaaggatttttctggtaaaacagctgcaaatgccaatttaaatccagaaaacatgaatttatatgaaatatttatcaacttatatattcaagaagtccgaaggcttgtgaaaaacggaataaaatcatcatatctcaatcaagaagaaaatcttaatgtttataagggaaaacttttggtaaatgaacatctcaaacaaaacattgttcataaagaacggttttacgttgtatttgatgaatatcaggcaaattgtccccaaaacaggctgataaagtcaactctattaaaattgcaacaactcacgggcagtgcacaaaattcaaaagagatacgtcagttattggtatcatttgaacttgtagaaccatcaaaaaattatgaaaaagatttttcaaaagtcgtgatagatagaacaaccaaatgttatgaagtgcttttgaaatggtcaaaggtctttctaaaaaataaaagttttagtatgttttccggaacggaatcggctcgtgcgttattatttccaatggaaaaagtatttgaagcttatgttgcaaagaatttaaagaaacgattgaatcaagccggatgggatgtatccattcaagataaaggctattatttatttgatacattgaatggggaaaaatatcaaaaatttgctcttagacccgatttagttatcacaagacctgacgaatcaattatcattttagatacaaaatggaaaagtctgataaacaataaaaaagcgaattatggtatttctcaggctgatatgtatcagatgtacgcctatgcaaagaaatatcaagcatcagaagtatggctgttatatccaatgaatgaagaaatgagaaatactgagcccattttatttgatagtggggatggtgtcagagtttctgtgtttttagttgacgtcgcacagatagaggagagtttagaaaagctttttctggcattcgcatcaaaataaaatgagaagaattccaaaatatacattacatcaaaagctgtcagaatgaagcaacatgctcgcccccaaaaagctgacaacttttgatgtcgtaaaaaatgaaaatgcctgcccaataagaataacacaaatagggcagcaggagtttctttatttcataaaacgaaatactcctatcacttttcccagaatctgaaaagtctctttgtctggatttaccagaatcggatccatataatcattttctggttgaagacgaatatgctcttcttctttataaaacgtttttacagttgcagaatcttcaattaaagcaactactttttctccattttcaacggtatcctgctgcgcaaccataacataatctccgtcaaaaattccggcatttaccatactgttcccctgaacaacaagcataaaagttggctgattcggtaaaaactctgctggtactggaaaatatccttctgtattttctacagctaaaagaggctgacctgctgcaacttttccaatcacaggaacgttaatcgtttcttttcgtacctgattaaaattattatctaaaatctcaattgcacgaggcttcgttgcatcacgctttatgtacccattcttttcaagcgtttctaaatgtgcatgaaccgaagatgttgatttcaaatgaactgcctgacaaatttcacgtacagacggtgggaatcctctgtttaaaatttcttttttcatatattctaaaatctcagattgttttttgcttattttaccatacgtcatctatttaaatcctcccgaaactctgcttaaaataaaggttcttttccttctcatcttagtattatcatatcatattcatagttataatgcaaacaaatattcggaatatgtgttcgcttacaaatgagatttttacttaaaagttacaataaacagtatataacagttgacaacagtattcatctgttatatacttgtttattgtaaaggagagattttataaatatgcatattatactgaatcattcatccatggtaccgatttatgaacagttaatggaacagattaaatcagaaattattcagtcaaaccttgtagaaggtgagggacttccatctgtaagaaaacttgccggagaactccgtatcagcgcattaactgtaaaaaaagcttacgataagttggaagaagaaggatttgtaacaacaattcatggaaaaggcacttttgttacagcctctgataaacagttagcagttgaagcaagaaaacgtgcagtcgaagaagaatttgacaaagcaattgataaagcagtttcggttggaatgaatcaaaatgaaattttagaacttgttcagctgttgttagatgaaaaataagaagaagggagagtggcttatgatagagatgcaggaagtggataagaattataatgattttcattttcacttatctatgaaaatacccaaaggacaaattacaggattaattggaaaaaatggagctggaaaaagtacagcaattaaactgattttgggacttataaaaccggactccggtacggttaaagtttttggaactccaataaaaaaattagaaccggataaaaaacaagctatcggtgtatctttggctgaatctggatttagtacacaacttacaatatcggatattgaacgaattttagagaagacctatattcattttgaaaaagaaaaatttgaacaaaaatgtaaacttttaaatctgccaaaaaagaaaaaacttcaggaattttcaacaggtatgaaagcaaaattaaaagtgttaactgcgattacccacaaagcacgtcttttgatattggatgagccaacctcaggacttgatattgaagccagaacggaaattttggatttattaagagattatctgatagaagatgagaatcggagtattttaattacgtcccatatttcagctgatttagagacactttgtgacgatatttatctggttcataatggaaaattgatgctccatgaaaaaatcgatgttattttagaacaatatgggattttaaaagtaacgaaagaacagtatgaaacacttgataaagaagcaattttaaagatacaaaaagaagcttatggctatgcctgccttacaaacgataaaaactattacttggaaaattatccacagatagcagtagaaaatggcaggattgatgcattgattcttatgacgacagggggatattaattatggcaggattgttagaaaaagatattcggttaatcatgcagagaaaacagatgttactgctatttgttgtaattgcagttgtgttaggtttttcacaagatggtacttttattttgggatatctgtctttttgcgcagcaattgttatggtaagtaccatttcttacgatgaattagaccatggatatgaatttctaatgacacttccgattacagcaaaaatctatgttaaggagaaatatctgttttgtattggtggtgcggttattgcatggctgtttgctgctattctttactttgtatccaagatgatacgcggagaacgcttttcttttcttgatgaattgccggttattctcattttcttaccaatcattttattgatgttgtctattttgattccattccagttaaagtatggaatggaaaaaagcagaattattttaactcttttagctgggattatagctgcaacaatttattttataaaaaatttaattgatggaaaccccagaattttaacagccataaattctgtaaatgatgaagtagtaactattattttatttgctttggggattttcgcgacattgatatcttattttattagtagtcgaattatggaaaaaaaagaattttaaaaaagacagctgtcggtttttgataccgatagctgtctaatttttcaagcctaatttacataatatattattacgtaaactaaagttaaataagtggatttcaaccgccagtatcgagtcttgggtgcctgccagtaatggcagttgctaagcgtagacagcgagaaaatagagagtgtgattgggcctcgaaattttgacatctagaaggctgacgctttaattccagcggaaagcaacacaaatcaaagtgaattcgttgccgatataggacattacaggagaacacctagatacagataatgagtatatgtattattattcggttgagtttgtaaaataagaatagcaaaaagagagaagaggatgccatggaatcgttgatttgatgattccgtggcatcctcttttggaggggaaactggatttatgatattgtggattttagaacttgtttcttatctttcggtactctcttggggaatatcctttcagcttgtggaaaagccggctgaaataaagctgattatcatacccgacgattttagaaatttcattgatggaataggttgttgtttcaagtaacatctgggcattgttaattcggattcccacaataaactgcattggtgtagaacctgtgtattttttgaagtttcggataaaccagctgacactcattccacgtgaggcagcataatcatctatgctaatattctggttataattttcgctgaaataggtaactgcagtgttcatttcctgatccaggtattcgtttttcagaatatgttcccgtgtcagttctcggtggaaagtgattagtagatgacgaagcagaagaacaagcatttcctcatagttgtcctgacagcgttgaagctctatgataatacgcttgaaaacccgttcatattccatagatgtgccgacttggaaaacccgttctttatccgggaatccatactgacgtaagatatttttaatattgctgcctgtaaaatgaatccagtatacttctgtcttatcttccccataatattcatatttctgaagttctttcggcctgtacagtacaatattaccggcgggaacaatcgtttcgttatctacattgtcaaaatgaaaatgcccacaaccagcggtgatatagatgatctgataatccaggcgtccccttggacggtaggttggtaattttggatggctggaaaggcgataagtgccacagcttcctacaatcagtgggcgacttttgtctttgaaatccatatgggagtggttcagataaccagtattcatatacatagggcagcacctcttttcctgctttttaccattgtatcatttagtgcatattttgtctaatccaattcatagacatattttgcggattaggataagctatgtatagcaaaacaaagaaacgtaaacaaaaaagtaaagaacaagacttgctgtgggagaacaacgtataaaaaaatgtatatgtattgaaggagagttatttatgattgtaccacgttattatgaggatttaagtgtattgcatgaaaacacaatgccagccagagcctattatattccggcatccaaacgaatggataacctggtggaacacagggaagaatcagaccgtatgcagttattaaacggaacttggaaatttcagtattataacagcatctatgatattcaggaatctttttttgagaaggattatgatacagaaaactttgacgagattcaggttccgagtgtatggcagatggcaggatatgacacacaccagtatacaaacatccggtatccgttcccattcgatccaccgtatgtaccgcaggatattccatgtggagcatatgcacatacctttatttatcacaaagatgaaaatgcaccaaaagccttcttgaattttgaaggcgtagacagttgtttttatgtatggatcaatggctcttatgtaggatacagccaggtttcccatatgaccagtgagtttgatattaccgaccttcttcaggatggagagaataccatagcagtattggtaatgaagtggtgtgacggttcttacttggaagatcaggacaaattccgtatgagtggaattttccgggatgtgtatattttgaaacgcccagagcaggcaatcagcgattatcatataaaaacaaagattgaggatatgcttgcaaaggtagaacttgatgtgaaattctactctccggcaaatgtaaaaatttcgattgaagataaaaatggagcagttgttgcagtaggaagtattaccgaagaaggaacagcggtgttagagattgcaagtccggaactttggaacacagaaaacccatacctgtacaaactgatccttgaaacagaaaatgaagtaattgtagatcatatcgcactcagaaaaatagagatcaaagatcaggttatttacttaaatggacagaagattaaattccgtggtgtcaatcgacatgattctgatccggttactggatttacaattagtgtggaacagattacaacagatcttacgctaatgaagcagcacaattttaacgctatccgttccagccattatccgaatgcaccatttttctatgaaatgtgtgacaagtatggatttatggtgatagatgaagcagatatagaggctcatggaccatttatgctctacagaaaagaagacacggattataatcgattcaagcggtggaatgaaaagattgccgatgatccggcatgggaagcagctattgttgaccgtgtgaaactcatggtagaacgtgataaaaaccgtttttgtattgttatgtggtcaatgggaaatgaaagtgcttatggttgcaactttgagaaagcactggcatggacaaagaaattcgatccagaccgtatcactcagtatgaaagtgcaagataccgtaattatgatgagacatatgattacagcaatctggatgtgtacagccgtatgtacccggcactttccgagattcaggaatatctggataaggacggaagtaagccatttcttttggtagagtattgccacagcatgggaaatggtcctggggattttgaagattacttccagatgatacaggataacgataaaatgtgcggcggctttgtctgggaatggtgtgaccatgcgattgctcatggcactgctgagaacggaaagacaatctatgcctacggaggagatcatggagaagatatccatgatggcaatttctgtatggatggattggtatatccagacaggactgtacacacaggacttttggaatacaagaatgtttaccgcccggcacgggttgtttcctatgatagagaaagcggagaactggtgcttcacaattatatggattttgatgatctggaggattatgtaaaaatcagctatgaactgacacaggatggactcgtgatcagtaaaggaaaacttgcagaagtttctgtggcaccacatagtgagggaaaaacaagcctgaatatcaaggttccggagaatggaaaatgttatttgaaactcatttaccagctgaaaaaagaaatgccattgttggagaaagaccatattcttggatttgatgaaattgaggtaagtaaagaggatacaaaatgtaaacttgcagagaaatggataccaaaaacagtagtggactctgaattacaggttaatgaaaatgatacacagattcatatcaaggggcgtgaatttgcttataccctagacaaacgtactgcactctttacagagatgaaattcgcagggcgggaatacttgaaccatccgatggaattaaatatctggagagctccaacagataacgatatgtacatcaagtctgaatggaagaaagcccactatgataaggcttacacaagagcctatacgacagaggttgtgcagggaaaacatggtgtgaagattacaagccatgcttccgttgtggcagagacagtacagaagattcttgatgtgacgattacatggaaaatagaagctgctggaaagattgatgcagatattgcagtaacaaaagacgatgaattcccggatcttccgagatttggtgtgaggatgttcctggataaaaaactttcagctgtaagatactttggaatgggaccacaggaaagttattgtgataaacatcaggctgcgagccacggtttgtaccgggcagatgtaggggatttacatgaggactatatccgtccacaggaaaatggaagccattatgattgtgaatatgtagagcttaacaacagccgatatggaattgtggtctctgcggaaaatgccttctcattcaatgcttcttattatacgcaggaagaacttgaggagaaaacgcataattatgaactgacagaatcagatagtgtagtattttgtgttgactatgcactaaatggcattggttctaacagttgtggtccagttgtattggagcagtaccgatttgatgatgtattattccggttccagtttacactgataccgtatataaagggataataaagtttcatgtaacccgtaaacaaggaaagagagtctgattgttatgtaaagtccggatatacagagcaatcagacaaaaacagagaaaaaactagaattagacatcatactctgttagacatcttgaaattctaagtgcgatgaagatgaggagcaaagaaattcgatggaagaaaaaaagtatttgaaatggtataacaaaattggatatggatcaggcgatattgcaggtaatgtagtctatgcgttcctgacatcttttatgatggtctatttgacggactcagtaggacttgctgcaggtgtcgtaggtaccctgattgccgtatcaaaactatttgatggttttacggatatattttttggatcaatgattgacaaaacacacagtaaaatgggaaaagcgaaaccctggatgctatatggatatattggttgtgccattacgctggtctgctgttttgcagtaccagtcagcttgggaacaacggctaaatatgcatggttctttatctcttacacactgttaaatggtgtgttttatacagcaaacaatattgcttattcagcacttacgtcactgattacaaagaacagcaaagagcgtgtgcagatgggatcttaccgttttatttttgcgttttcaacaagccttctgattcaggcaattacagttggatttgtagataaatgtggtggagatgctgcagcatggagaacggttgctattatctatgcaatcattggtcttgtcgtaaatacgatttcagcactttctgttaaggaacttcctgaggaagaacttaacgaaggagaagtaaaggatgataatgaaaagtacggaatggtacaggcattcaagcttcttgttaaaaacaaatattacatgatgatttgtggaacatatattttacagcagttatatagtgccatgattggagctggcatttattacatgacatgggtactgaaaaataagaatttgtttggacaatttgcatgggcagtaaatattccactgatcattgccctgattttcacaccgacattagttggtaagtggaaaggtatgtataaactgaacttaagaggttatgtcttagcagtcatcggtagagcacttgttgttgttgcaggatatatgggcagtgttccgctgatgatggcatttacagctcttgcagcattaggtcagggaccatggcagggagatatgaatgcagttatcgcatcctgctctgagtacacttatcttacacagagaaagagaattgacggaacgatgtactcttgtacttctcttggcgtaaaaatcggtggaggtattggaaccgctgttgttggatggctgcttgagttcagtggatatatcggaacaaatgcaactcagccgcagtctgcacttgatatgatgcagtttatgtatctttggcttccgttaatctttgatgtattgattatgtttgtactttcaagaatgaatgtagaagatgcaaataaaaaactgaaagcagaaaaaggaattgctgctgatgaagtaacagatgcatcagacataaattagaattgacaggagaaagcgttgtctggtcattgctcgatgagacagtgcttttttctatatataaagtgattgaactgtattttgaaaataaaaaaggaccacttcatttttgtgaaatggccttaagaaaatattcagttttcacaaaatagtccttttagtatttatgcatggtaaggatgctcaaaatattcagtgtagaatactaaaaggtcattcagatatttttttaggttgctcatttgcaattcctcctttccttatttacaagttgattataagataggtgtaaaaggattgcttgccaaatcgaaagaagatatagacaaatgttgcaaaggggagtatttcatgcagttaaaatatgttgacacaaaagaggagatcatagcaataaataggaagtcaaaacttattgaaccacatcttcataatgcactggagatcgtttgtgtaacaagtggagcattagaacttggtgtcggacaggaactataccatatggaaaaaggagatataggctttgtatttccagatgttattcatcactatcaggtactgacacccggtgtaaataaagcgacttatctgattgcatccccatttacgatagccaaatttgcagatatcatgcaatccatggctcctgaatatccaatcatcaaagcggaaaaggttgaaccggaggtatatagggttataaatgcaattttagagacagaacagtcggatattactgttgcacaggcatatcttcaaattgtgttggcacgctgcataggaaaattaaatttggtagaaaagagtaatgtggggagcaacgatcttatttaccagacagtttcctatatatcagcaaattttaagaagaagttttctctggaagagatggcaaaagatctgggggtgagcaaatatgttttatccagactcttttccaaaacattccatataaactttaatcaatatcttaacgatgcaaggctgaactatgcatgccatcgtttggaaaatacgagtgattctattacaaacatttgtctggatagtggatttgaaagtcagagaacatttaaccgagtatttaaagaaagatataaaatatcaccgagtgactaccggagtacatgtctgaaagatatgttgtcataacatatagattaataaactcaataaaaatctgattatcagtctgaaataagtatctctgggtgttatttataatatggggtagtggttaattattatgtcatgtatgaatggggaagaaacttaaaaaagacagctgtcggtttttgataccgatagctgtctgatttttcaaacctagtttacataatatatttttacgtaaactaaagttaaataagtggatttatttgagttataataaaaataaatactcaagattgcgaaacagcagaggtataaataacaaagagatatcgtaaagataaataatgttttagcaattttataaacttacttataaattcactacagactttttgcaaggaaaaaataacaacaatgcagcaggaggaagttaagcgatatggacaagagagaactcatagcacaaaatatttcacaattttgaatattctacggtaaacgcagagataaaaggcaaagtagaaagtatcttaaagccgaagagcggaacaataaaagcagattgcatcaacaaattgattttggaagaaaatagttataggacaaaaattatttgtccaggggtaatttgtcgattagaacacgcagagtagtactggataagcgagaaaagtttagcggacaaatacagatttaaccgctaaagtctggattttttatttttgatatgttaaactactcccaaacagttacttttaggaggttttttatggcaaaacaaatcacttatcgagaacaggaaaaaattcaaaatacaatgaaacttcgagaatttttatcggaacttccaccctacgcaaaggattattttcgtgcaaaagaaccgacgacatctgataaaacccgtttatcttatgcgtatgatttacgagttttctttcggtttcttcaagaaagtaatccgaacttaaaagaaaaacaaatttctgaaatttcactttctgatttatcggcacttcagccagttgattttgaagaatttgaagattatttaaaggtttatcagacaccagatggacgcacggaaacaaattcgcgtgtcggaattgcacgaaagctctcctgcctgcgtagtttttacgaatatctctgtaaacgtcagctattatctgagaatccagtacgcttgattgatatgccacgtttaaaggaaaaagccattattcagcttgatcctgatgaaattgcatcattactcgattatatggagaattatggaaatggattaacaggtgtacaactttatcactataataagcaaaagtatcgtgatattgcaattgttaccctgctgctcggtacaggcatccgtgtttccgagtgcgttggacttaatatttctgatgtagactttaaaaacaatggaattcgcgtgttaagaaaaggcggaaatgaaatggttgtctatttcggacttgaagtggaagctgcgttaaaagactacctggaactttccagaaacaagataacaccactttcaggtcatgaaaatgccctgtttttatccggtcagagaaagagaatcagcgtcgatgcgattgaaaaaatggtcaaaaagtactcttctgctatttcggtaaaaacaatcactccgcataaattaagaagcacctatggaactgcgttataccgcgaaacaggcgatatttacctggtggcggatgtattaggtcactcagatgtaaatactaccaaaaagcattatgcgcgcttgagcgatgacagacgtcgtgctgcttcaaaagcggttatcttacgagaaaaaccagattcacacaattcttaaaaagaaaagaaaggcggaaatatccatatatcgaaatatcgaacataagttcaaacagacatttttgcctttcttttttatttttcaatagcaaaataacacgagagaatgtcaaagaatgtttcagcaatattacttacccaagcgctacatccagaatcatcatgacactaaaaccaacagcaaaaaacaaagtaccgatattagagtgttttccctctgacatttctggaatcaactcttctactacaacataaagcattgcacctgctgcaaaacttaaaagataaggaagtgccggaacaatttgatttgccattaaaatcgtaaaaactgctccgattggttcaacaattccggaaagtacaccaccgacaaatgcttttgatcttttcatgccctctgcacgaagcggtaaagaaataattgcaccttctggaaaattttgaattgcaattccaagagacaatgccattgctccggcaactgtaatttcagaatgccccaacagatatcctgcgtaaaccacgccaactgccattccctctggaatattatggagagtaactgcaagaatcatcatggttgttttttgcagacggcttgcaggaccttctgctgtttcactgttttgatgcagatgcggaataatatgatctaacaataataggaataacgtgcctatccaaaagccaatagcagcaggtaaaaaagcccatctccccattgaatcagactgttcaatagcaggaattaacaaactccagatagaagcagccaccattactcctgctgcaaatccagttaaagcacgctgaacctgttcttttaaagttttcttcataaaaaagacacaggctgcgcctaaagaagttcccaaaaaaggaatcaagattccataaaacacgtgttcgttcataatgaaaaatcctcttttctttttatagattataatatgcgattagtcttaactaactacatattataacggacttcttttaatttgtctactatcctgttggaatagacagttatttttccttatgttataattcagagtagtaaaattattgttatatctaacttaaagacgatacgaaaggatttttttatgcctggttttatcttacatttaactgcagctcaaatactgttaaaaagacttccacatcatcctgattttccatacgaaatttcttcggtaaatgattttttgatcggaaatcttcttccagatacaacaaaaccaaaagatgcctctcacttccgtaactcagcttattatgaaaaaatgatggtatttccggatttaacacgttttctgcaaaaatatagttctctgcttgcaaatcccagtgtgcttggatactattttcatctttatattgaccgaaaatttttcaaagatttcattcctcaggtcgtagaattttatgacaaaaatggacagattacagatattcgagatgaggttgcgacagtttatattcaaaaatcgcaaacttctatcccattttccaagtatctcactgaagaatactattacggagattatacaaggatgaatacttatctggtcaatcaatataaaattccacttgatttaaatccagaagttgtaaatccaggaatttcagaaatttgttataaagatgtgcaggaggttctcttacaacttcatggctttctagctgtttcaccggaagctgtaagagaacttaaggtatttccacttgaaaaactgcttttggctttggaagagtatgttgaagagtttttatctgttccaaataaatatttgtgattagacgaaatatttcgtactattcttcatgctttatagtttcattttcgcccaaaatcttataagtttttaaaattttttcaaagtctctatcatgtttttcacgttcttcttttgtatattttgtttctccaatacaaattgctttaggtataccatgcttcaattcttcgctcattatatttctccataaagtataatatttgccattataaattcattaatcaagagataggtatttactttaataactccaaataacgaatggcttcatatacattatatacattagaaaaaattttacaaagtgtattgtatcttgattattttgggatttatatatttataagttaataaactcaataaaattctcaataaataaataatagtttccataacaatatattatggaaactaaaaagcaaaaactgtaaaagatgtaaaactatttcatgctcatgaacaggaataggaagaaaaatagatagaaagtcaaaaaagaacctccttgaataaggaggttctttttgcttcttatttattattcgtttttaatttacaatgtttgtttatcacaattcgtttaattaacgaaaactctttaaccagtttactaaagaatcatgccagatattctcagctacggttctcttcatatcttctgtaactggaccattgtttgccatttttccaagaatcgccgtctgtaactcttctactgtcatttcttctggtgttttatttgcaattacagccatactatcaacagcttctgcctgttccgctttcgtttcggattcggaagcatctgaattttctaaagtcaattctgaagtcaatgaggcagcaggaattgattcttctacagattcttttacatcttctgtttcggaagctttttcagctatatctgtaacatggtcaactggtttctcaattacctctgtttccttatttacttcttctattacaacttctttctctgtttcttgtttgctttcttttttagcttctttaggcagctctacttccggaagttttccttccatatccgccggaatccagatttctcctccatttgcaggaactgtaacatggatttgtccattttcaacagaaactttcttaccgcttaatgcgccaatatactgagctgtatttccggcagaaagagtcatctgtgcatcattgtcatcattattcacggttacaattacttttatatcatctaattctcttgcaaaagcaaattggcggtttgtcaactgtagttctgcatatccaccataacttaatgcaggagtctgctgtcttacttttccaagtgcggtaattaaggcagtgcaaggattttctttgactgcgtttttatagtcttctaactttaacgccggacgcaggctgtcatctgagaatttttctttctttccttctatagcaaattcagagccgtagtagatgctcggtatacctggtaatgtataaagaagaatatgcaccggtgccatatgtgccttattagaaagcttggtataaatacgttctacatcatgattatctacaaaattatataaatcaagttttcccatattcagcaggtattttacggtatgcgcaatttcaaaataattatggtcgttatgtccactgtaaagtgccttatgcagtgcatagtttgtaacactgtgcagagtatccccatttacccatcggctgtaatccccatgaatgacttcacccataagccagaagtcttctttcacttcttctgcggtacggcgcagagcgtgcatgaaatcaaaatcaagcacatctgctgcatccagacggattccatccacatcaaattcagatacccagaatcgaatgacatcgcagatataattctgaacttccggatttcgctgatttaattttacaagcagattgtaaccgccccagttttcataagaaaatccatcattgtattcattgtttccaccaaaattcacattgcaataccaatttaagtatctggaatgttctcgattctgctgaatatctttaaacgcaaaaaaatcacgtcctgtatgattaaagacaccatcaaagattactttaatctgattttcatggcatacttctacaaatttttttaaatcttcattggttccaagacgagaatccagttttttatagtccgttgtttcatatccatgtccaacactttcaaacaacggaccaatatataatgcagtacatcctatttcttttatatgggaaatccagggaattaaagtgttcagacgggaaacaggagttccataatcattttcttttggagcacccgttaatcccaatggataaatgtgataaaaaattgcctcgttataccagctcatagtacacacctctgtctttttatttgttggagtaaaaagttttaccccttaacatctttgtatataataacagattttttacttgttttccagattattttctatcatttcgccataaatttatattgttgtcttttctggagtgtggtaaaataattttcgtttacaaaaataattttcgtttacaaaagaataaaaacataaaactattttttgaatcaaagggggattctgattattatggaaagggatatgacaaaaggcagtcctttacttgttattttgaaatttacacttccgctgattatcggaaatatttttcaacagctttataatatggcagatacaattatcgttgggcattacgtcggagccaatgcacttgcagcggtaggttcaaccggaacaattatgttcttgattgtcggacttgcacagggaattactgctggttttactgttttgacttcccaacgttttggtgcgaaggatacgaatggcgtaaagcgaagtgtcgcaaatggaattttactttcacttatcagtacatttttattgacaactttcagcgtattgtcgatgcactggattttaacaaaaatgaatactccagcaaatatttttcaggatgcttatacgtatatcatgattatcagtggtggactgattactacgattttttataacctgctctcctcttatctgcgtgcggtaggaaacagtcagattccattagtatttctggttttttctgctgttttaaatgtaattttagacttgattttgattattaaatttagaatgggagttgccggtgctggttacgctacgattctttctcagggaatttcggctgttttgtgttttctttatatttaccgttatatgccggatttaactccacaaaaggagcactggaagttttatttggcggatacccgccatcagttatctgtcgggattccaatggcacttcagtttgcaattactgcatcaggtacgatgattatgcagtccgcaattaacctttttggttcagatgctgttgcttcctttacggcagcaggaaaactgcagaccctggttacacaagggatgatggcaatgggacagactatggcagcttatagtggtcagaactttggaaagggtgatattttacgaattaaaaaaggagtaaaatctgcccttcttgcttcaacggtttattccatcgtcgccgctgttttgatttgttctcttttaaaaccgtgtctgggacttttctttactggagatgtcgatattacagtaatgttgccttgggcaaagacttatgcttatatgtgcgcaattttctatatcccgctaagcacaatctttattttcagaaataccatgcaaggctgtggctacggtttcttgcctatgatgggaggcgtttcagaactgctggcacgtctgctggttgcaatgattgcaatgtctgtggcaagttatccgctttcctgcttctgtgaccctgctgcatgggtaactgcggcggtctttaccggagtttcttatctgtttgtcatgaaagatatcgataaaaaataccgacaggcatcgtaaactaacaaaaaacaaaacaggaactggaacagctatattaaaagattgaaagagctaatttcatcatatagaatcatataaataaaaagacttgttgtcagagcattttatggcagcaggtcttttggttttatgctataataagtaaaaaatgaaaaagaaagagagtgatttttatgtcttacataacagatagctacgcattaagcggtgaaaccttagtaaaacaatttaagaaacgaaacatggaagcgttttattgcgcaaccaaagaggaagccaaagaaaaaatcctttccatgattccaaatggctcttctgtcacctggggtggtacagaatctatggaagaagccggtgtatgtgaagccatccgtcagggagattatgaatttattgaccgaaaaaaagccaaaacaccagaagaatcccgtgcactgtatggtcagatagtctgtgcggattattttttaaccagttccaacgcttttacaaaagatggaattttagtcaatattgatggtgcgagcaaccgtgttgcctgcattgcgcatggaccggcacacgttattttcttaatcagcatggacaaattatgtgcaaatgttgatgaggcgattgaccgtattcacacacatgcctgtcctccaaatgcacttcgtgtaaaagcaaatacaccttgttctaagaccggtgtctgtgcagattgtttaagcccggactgtatttgttgtcaaactttaattacaagattttctcgcataccagaccgtattaaagtgatactttgcggagaaaaactgggattttaaatttttttgacccaatcaagtaatgaggcagattataaatatctattcaaaaagaccttctacgttctgaaaaaattgtagaaggtctttttgaatagatatttatttaattttaataaaatccacagccactttttccatactcttttatatagtaaagcgccttattctttttcactttgaaaggaaataaatccaaacaaagtggcgacaataattgtgattataatactccaagtacttactctttcgatttttattttccgtttcattttcactaaaaatctccatatttattttttatgtaattatactctcttcaagctatcttttcaatttcgttctacagaacaatatcgaaaattttatcaaagccattaatttttcttgtgtttttaaacagatagatttaaaatttttattttttgtgtgtggtgttggtttttgatgttatagatatatttcatactataacattgtgataacaaaaaaagaaccgaccgaatttattttttcacagccgactcttttcccctatttcttattttacacgaatctgatagctcttttcaaatatttctcctgctttgagttcatttccccattctctttcttctaatttcttagaaaaatcttctttatcacttctgccataccaaggttcaatgcatacaaatggcgcactcttctttgccggtgaccagattccaaataatggagcatcaaattctacttccagataagtctctccctgaggattcacaagccctactctctttgcctgatttccttcgataattaacgcatcttcatcaaataaatcttctactattctcattttatgattggttaattcaaattctttttttctggcagtaagcagtccggtctctcctaagatactgcatacaagagttttatctgtatcaaagctcaactgataatcactttgtttctcttctgcttttaatggacagttaaatgcaggatgtcctccaattgaaaaatacatcttcttctcatttggattttctactttccaaagcacctctacacttcgcccatccagacgataccctaaatgcagacgaaatgcaaacggatattttttcaaagtctcttcattttcttttaactcaaaccagatttcttcttctttttggctttctaaagtaaattccatatcccttgcaaatccatgttgggacatagaataagttttcccttcaaatacagactctttttctctgtaatttcctacaatcggaaataaaaccggtgaagttcttccccaatatgcagaatctccatgccataaatactcttgattcgttttattatcttttaaagatttcatctctgctcccttagaagaaatctttaatgttaattcctgattttttaactggtactctgccattttccttccccctctagtcttcaaacacctgtctgatgctgtcataatgcaggaaaattccctgttttgcataagccttgatttgttctactgtcgcaatttcaaatcccgccacttcttcgtcctgtacttttacatctttttcatcaaactccagcacaaacttataaatatctacaaaataattatttttttcttccggattaattcgctgataggtaaatacataaccgcctccggcatttgaaacatcgattcctgtttcttcttttacttcacgcatggcagcttcttttgattcttctccggcacggactccgccacctggcacctcccaccagcctgctgcccattccttatccatacgacgctttgtaattaaaaatttcccatccggtctttgaagcactccaagtacggtaagatgaaattcatccggtttcatattccagtcgttacgcttcattgttcttcccattttttcttttttttcattatagatatcccataattccattttactttctcctattttctcttattttgtaatttcttttgcaagttctgccagttttttactgctttctttaatattcggctttgcataaattcccgacacaaccgccactcctgcaacaccactaccctttaactgcagaatattctcttcacatacaccaccaatagcaacaaccggaattgaaacactctcacagatttcttttaatacctccatcgaaatcttatttgcatctcctttggttgttgttccaaagactgctccaacccctaagtaatctgctcccatttgttctgcttcttttgcctgttctacggttcgtgcagatacgccaatgattttatcagcccctaatctttttcttacctccatagctcttgcatctttttgtccgacatgaactccatctgcatcagatgcaagtgcaatctctacattatcattaataatcagcggtatctgatattctttagttaattttctgattacctttgcttcttctaaaaattcatcttcctttaaggacttttctcgaagctgaatacaggtcactccacctttcagggaatcttctatctgctcttcaaatgtcttatctcctacccaggcacggtctgtcactccataaagcagcaatgcctgttttactttttctcttttttcttctatcgtcacttttgctatacctttctttctatctctttatttttcctcattttgaccccattctatcatagattccaaaaaactgcaaaaccaaacgttttgtatttttttcagaacctgaatttatgtcgttgactttatttttatcttgtgctacaaataaactcgtaagttatatttctcttcttttatggaatactatggtaaaaatttctctttttacgatagaccattttacatttcaaagaagaaatcaatcatttttgattgtttctttcattacaagattccatttttattcttttaaattcgaatcttgatatagaatggtttcgttttgtatacaatatacaattttaccatatcttaccaattttagactttttactaccagactcaaaaagaacaggaggtacttatttactatgatgagacaagaatggagaacttttaatggcggagcatgggaaaaagaaattaatgtccgcaattttattcaaacgaactatatcccttacgacggaacttccgatttcttagaaggaccaaccaaagatactaccgatttatggaatgaagtacttgacttatataaacaagaacgagaaaatggcggtgttctcgatatggatacgaaaactatttctaccattacttctcataaggctggatatatcgacaaaagcaaagagaaaattgtcggtttacagactgatgtcccgttaaaacgttctctccaaccttatggtggaatccgtatggcaattaaagcgtgcgaagacaatggttatcatgttgaccctgaagtcgttgaatactttaccacgcacagaaagacgcacaatgcaggcgtatttgatgcctataccccggaaatgcgtgcctgccgttccaatcatattattacaggacttcctgatgcttatggacgtggacgcattatcggtgactatcgaagagctgctctttatggagtagaccgtttaatcgaagaaaaagaagaacaaaaagcaagcacccgtactattatgtattctgatgttatccgtgaacgagaagaactttccgagcagattcgtgctttacagatgttaaaagaactggctaaaatctatggctgtgatatctctgctccggcaacgaacctacttgaagcaacacaggcattatactttgcttaccttgctgccgtaaaagaacaaaatggggctgcaatgagtcttggacgtacctctaccttccttgatatttatacagaacgtgacttaaaagaaggtacatttacagaaaaagaaattcaggaaatcattgaccagtttattatgaaactgcgtctggtttgctttgcccgtactccggaatacaaccagttatttgccggtgacccgacctgggtaactgaatccattggtggtgtcggaattgatggccgtccactggtaaccaaaatgtccttccgttatttaaacactttaaataatttaggtgctgcaccagaaccgaatctgactgttttatggtctgttcagcttccagaaaactttaaaaaattctgtgctgatatttccatcaaacattctgccatccagtatgaaaatgatgacattatgcgtgttgttcatggcgatgattacggaattgcctgctgtgtttcttccatgaaaatcggaaaagaaatgcagttcttcggtgctcgtgcaaatcttgcaaaatgcctgctttacgcaatcaatggcggtgttgacgaaatttccaaaaaacaggttggaccaaaataccgcccaatcacttctaaatatttagatttcgatgaagtaatggataaatacaaggatatgatgaaatggcttgcaggtgtttacgttaatgcattaaacatcattcactacatgcatgacaaatacagctatgagcgtcttcagatggctctgcacgataaaaaaataagacgctggtttgcaactggtatcgcaggattttccgttgtagcggattctttatcagcaattaaatatgcaaaggtaaaaccaatccgcgatgaacaggggattactgtagactttgaagttgaaggagatttcccgaaatacggaaatgatgatgaccgtgttgatgcactcgcagaagaagtacttcacacctttatgcagtatatccgcggaaatcacacttaccgtggcggagttccgacaacttctattcttaccattacttccaacgtttcttatggtaaaaatacaggagcaactccagatggaagaaaagccggagaagcctttgctcccggtgcaaacccaatgcatggacgtgatactcacggagcaattgcttctcttgcctctgttgccaaaattccatttatggatgcgcaagatggaatttccaacaccttctctattgtgccggacgcacttggcaaacatggaaatgatactacaaacttagttggaatgttagatggttatatgacaaagggcggacatcacttaaatgttaatgtatttaaccgtgatactcttttggatgcccagaaacatccggaaaattatccacagcttaccatccgtgtatctggatatgctgtaaactttattaaattaacaaaagaacagcaggatgaagtaatttccagaacgttccacgaacgcatgtaattttgataaaaaaggagattaaacactatgaaaggtcggattcactcactagaaagttttggtacagtagatggaccagggattcgttatgttgtattttttcagggctgcccgatgcgctgcctctactgccacaatccagatacctggagtacagaagctggaactttaatggaaagcgatgaaattttaaacgccattaaaagaaatcagaccttttatacatctggaggtatcaccgctactggcggtgagcctctgatgcagatagaatttttaattgaacttttcacaaaagccaaagaaacgggaattcatacctgccttgacacttcaggaattttatttaaccgagaaaatcctaaaaaactggcacaatttgaccaactgctttctgttacggatttgattctattggatatcaaacatatcaatcctgatgagcataaaaaactgacttcacattctaacactaacatacttgattttgccagatatctcgatgagaagcagattcctgtctggatccgtcatgtggttgttcctgaaatcacttataaaaaaaattttttaataaaactgggagaatttctttcaacccttcataatgtaaaggccatagaagtacttccttatcataggatgggatgtgtgaaatatgagaatcttggttttgaatatgcattaaaagatgcaccccagcttacaaaagctgaggcgcaaagagcagaggaaattcttttagaaagtatcaaagcgcatacaggatgcgaatttatttctgattttggacggtaagtttaactcaaatatctgtgagataggtttttaaaaattcataaatctctgtttctgtagggggacatccttttaagtgacatgcaaattttgcggtacaatttccgattccaagcgttccgctttttcctcggaatccctgtccgattgcaatttttgtatctaactttttaagaagtccctcttcttttaaacggtctaatgccggcatcagatatccatagcaggcactgcaggattctacctcttctaccgcatctaaaagttctacaatttttctctttcttacttctaaaatcgccgcttctgttggtgtttgagttccacaactttttatcactgcatgttcaatatccgcactgccaactccaagtttttctgccattaaaatatatggcacttcttttatctcataattcaaaaaacgacacacataagcgtcacataaaacaggatctgttaccgccaaaattcgattcatcacaaccggatttccaccatcttcaaaatccaaatctccgcagatattatcgactacaataaaatcctgctgaagatacgcattcaagtgtgcaatcggctcatgcagacccattgtgtgaaaatgacgtttttccttatttggaattaacccctttaaattcttaagcgcacaggtcagcttcgtctgacagtgtccttttaagactggtacattaatcaaaaaatctaattttaaagctgtatcacaaatcagaagttccattcctttacaatcgcaaagagaactgctgtctttctgcatatctgcaagcggtacctgatatttttcagaaagtttctgatatccgcatacctcaaaagattcttctgttttatcaccaacccaggaaccctctaaaatcactaaattttgatatcctctctcctgaagatattcaatcattccctctaccacctcaggatgtgttgttccaccataagaggcctcactcggtgcgacaagattgggcttaattccgattttacaatttttattttctccattttttttcttgatttctgtttctaaatctgccgcttctaacaaatgcttggtattttctttatagtctgtaccctgtatcatccagatttcattttgattcattttgattccaactttctccacgttatttataatttaaaaaagaagccacaaaaaccttctttctggcttatcttaacaagccggactaaaaagttcaagtaacttcttctcatttactttttatgctgtctcttccgcaaaatttccggtataaagctgatagtattttcctttttcttccatcagctgttcatgtgtacctctctcaataattcgtccctgctccagtaccataatacaatctgagttccgtaccgtagaaagacggtgtgcaataacaaaagttgttcttcctttcatcagacggtccatcccctgctgcaccaatgtctctgttctagtatcaattgaagaggttgcttcatctaagattaataccggcgggtctgcaactgctgctcttgcaatcgctaaaagctgacgctgtccctgacttaagtttccgccatctccacttaactttgtctgatatccttctggtaatctgcgcacaaagctgtctgcattcgccagttttgctgccgcaatacactcttcatctgttgcatccaaacgaccataacgaatattatccataacggttccggtaaacaagtgagtatcctgaagcacgataccaagagaacgtcttaaatctgcttttttgattttattgatattaatgttatcgtatcggattttaccatcctgaatatcataaaaacggttaatcagatttgtaattgtcgtttttccggctccggtacttcctacaaacgcaattttctgtccaggcgttgcaaataatttcacattatgaagtacaatcttttcttcattatatccaaaatcgacatcattaaaggtaacatcaccttcgagtttggtatatgttaccgttccgtctgcctgatgtggatgtttccatgcccagacgcccgttctttcttttgtctcttctaatgttccgtcctcatgttcttttgcattgacaagctctacatatccatcatccacttccggctcggcatctaataagtgaaagatacggtctgcaccagccattgccataacaatactgttcatctgctgactgatttgagtgactggctgggtaaagcttttattcaatgttaaaaaagaaaccagagtaccaaggctgagtccgcaaattccactgattgccagaattgcaccaaatgcagaacataagacataactgataataccaagattattattaatcggcatcataatattggcaaaggtattcgcgttatctgcgctctttctgagttcttcatttaatttttgaaactcttcgattgctttttcttcatggcagaatacttttacgactttctgtccatccatcatttcctcgatgtagccatttaccttaccaaggttcatctgctgttccccaaagtattttccggatttttccgccagttttttcgatacaactgtcatcacacctaccattaagagcgtcagaattgtaagcgggatatcgagtacaatcatactgataaaagtcattacaatcgtaaccgccgagtttaatacctgtggaatactttgtcccataagctgtcttaaggtatctacgtcattggtataaacagacatgatatctccatgtgcatgggtatcaaagtatttaatcggtaatgattccatgtgtgtaaacaattcaacacgaagatttctcatcgttccctgactaatatataccatgattttattatatgctaaagaagaaataactccaacagcaaaaattccagccagtttggtaagcgcctgcatcagaggaacaaaatctggtgtttctgcttttgtcatcggtacaatataatcatcaatcaaagactgcataaataaacttccctctaaggttgcaaatgcagtaatcataatacatatcacgaccagaagaaactgaaacttataatttttcagcatatatccaagcgttctttttaatgtttttgtcggattcggcgcaccgttttttccaaatggtccacctgccactcctggaccgcctctcattactcttgcctgtcctgccattattttgcacctcctgtctggtcaaaatctcctccaccttttacctgcgtattataaatttcctgataaatctcattggtttttaacagattttcatgtgtatcaaatccattaatctttccgtcatccaatactaaaatacggtctgcatcctgcacacttgaaattctctgcgcaataataatttttgtcgtatctggaattttctttgcaaagacggaacgaattttcgcatctgttgcagtatcaacggcactggtagaatcatctaaaatcaaaatcttcggtttctttaataatgctcttgcaatacaaagtctctgtttctgaccaccggatacattacttccaccctgttcaatatacgtctcatatttatttggaaaacgctcaataaattcatctgcacatgcatttttacatgcttcaatacattcttcttttgtcgcagtttcatttccccaacgcagattttctaaaatcgtaccggaaaacagcacatttttttgtaatacaactgatacctgatttcttaatacttccaaatcatattcgcgtacatcttttccaccgacacatacagaacctgcatttacatcataaagacggctgattaaatttaccagacttgattttccacatcccgttcctccaataataccaaccgtttctccggaatgaatatgtaaatcaatgtcaattaacgtatctttttctgcttcatcattataagtaaattccacatgattaaaatcaatacttccatttttcacttccatgattggatttttgggattaaccaaatccgctttatcatttaatacttctgcaattcgttttccacttgcaatactaagtgttgtcataacaaaaatcatggacagcatcataagggccattaaaattgacatgatgtaactaaacatagaagtcagttcccctgttgtcatatttccaactacaatgaattttgctccaaaccaggataaacagatgatgcaaaaatagaccaccagcatcataaccggaccattaaaggctaaaatcccctctgcttttacaaacagtttatagacattttcggccgctgtgataaattttttattttcatagtcttctcttacaaacgcttttactacacggatggcagaaacattttcctggacactggcatttaacgcatcatattttttaaataccatatcaaagattttcattgttgtctttaccactacaataatgaaagctcccagtaccacaatcgcaattacaaaaatcagacttaattttgcattaatcacaaaacacataatcatactgcaaatcagcgtaaatggtgctctcaccgcaattcgtaatatcatctggtaagcattttgtacattggttacgtcggtagtcatacgggtaaccaaaccggctgtactatatttatcaatattagagaaagaaaatgtctgtatattttcatacatagcgtccctcaaattacaagccagccccgaagatgcatttgccgcatattttcctgcaagcacaccaaacaacaaactaaacatggcaaataccaacatgatacttccatatagtccaacttttttcatatttccagcctcaataccctggtcaataatcatcgcagtaataaaaggaattaatacttccattactacttcaagtgctgcaaacaaaggcgtcaacagtgatgattttttatactgtttcacctgtgccaataaagttttcagcatttttttacctcctaacacacgaatttattttataagcctttatatttttacatattttctctagaaagtaaatttaatttttgttattattaattaaaaaattttattaatatttcagaaaggatttttattattatgaatactatgcagctcgaatgttttctcgcagtcgctgataacttaagttttgcaagagcagcggaacagcttcatgtaactcaaccggcaattacccatcaaatcaattctcttgaaaatgaattgcaagcaaaactagtccgaagaactacccgtattgtagaactgactccagatggtagaacttttctgggttatgccaaaaatattttaaaagcaacacactttgccaaaaaacgtttatctgaacatcaccaggattacatccagactttttctatcggatgtcataacccatccgaattaaacttaatttctccggttttaaaacagctttatcaaacgtttccgatgctacatcctgatttgcgcatgattccctttcctgccctcagaaatatggtcgaagaagaagcgattgatgtcatgataggatttcgagatgaaaaaatcaaccttgcttctgtcacttatgttgaacttgcccagtgcggaatcacctgtgccctgtcaaaagaacatcccctcgcagatagaaaacaactcacgttaaaagatttaaatgaagaaccaattgtcttatgtgaaccggatcgctgtgcagaagcgattgctcagcttcaaggtcatcttcttgcttctcattctcactctccttcccagatttattttggagaaaatttagaatgtactttaactcttacaaaagcaggaatcggactcgccctgctgccaaatcttccattcatgcaccaggaagggctgacttatgttcctcttgaaaatgaaagtattatctcttttggactttatcataaaacgtcttttaattcaccgatcctaaaaactttcattcagattttaaaaaaactttgtcaacctttttgaaataaaagccaggacaagataatctcattgttaccctgtcctggtttttatcattcacaaaattaataataaagaaatgcaggcacacatcaaatgatatatacctgcatttctgcttttatctttaattttctgctttcttctatttaccgtctctctgttttaaatatgcagctctgccctcttcataaaggttattcccctcactgtcaatgattacaacaagaggcatatcctccacatataactttctgagtgcctctgctcctaaatcttcatatgcaattaattctgcttttttaatacattttgcaagaagtgcgcctgcacctccgattgctccaaaataaacaccatgatattttttcatcgcatcaattacttctggaagacgtgcaccttttccaatcattcctcttgcgccgacagacatcatagttggtgcgtaagcatccattcgaccactggtggttggtccggctgaaccaattacctgtcccggtttagccggtgtcggtcctacataataaatcgttgcatctttcgggtcaaatggaattttctctccttttgccagtgcctcacacattctcttatgtcctgcatctcttgatgtataaattgttcctgtcacaagcacacggtctccgctgtgaagtgttttagccagttcctctgtaagaggcagcgtgatttttctttccatcttaaattacctccgttttatgacgcgttacatgacagttaatattaatcgcacacggcatacctgcaatatgagtcggcattgtctcaatgttcaagccaattgctgttgtctttccaccaaacccctgcggtccaattcccagttcattgattttttcaagcatctcatcttcaagctctgcataaaacgggtctggattagaagaatccaatggacgcattaatgctttttttgctaataaagctgctttatcaaaagttcctccaattccaactccaacgaccataggcggacatggatttggaccggctgtctctactgtctcaataataaaatccttaattccctggagtccgtgagacggtttaaacatacggatagcactcatattttcacttccaaatccctttggacctactgtaattttaatctgttctcccggaacaatttctgtataaatcatagcaggagtattgtctcctgtatttccacgacgaacagggtctttaacaaccgactttctcaaataacctttgtcataacctcggcgaactccctcatttaccgcatcactcaagtctccgcctactatatgtacatcctgaccaatctctaaaaaaacacatgccataccggtatcctgacaaattggtacacattcattatctgcaatttcgaaattttcaataatattatctaaaacaccttttgcaatctctccatcttcacaggcacgacaatttttaattgcacactttacgtcttccggaagatgttcatttgcctcaatacaaagtttttcgattacgtcggtaatctggcttacattgatttctcgcattttaccactcctactctgttttcttcttatctctcatgacgtgcataatgtggaagcaataacggagatacatcatctgatgtaatgcctgcttctttcaattcttctgcatatttttccacatgttctaaagtcatggttccaagctctacggtttttgattttgcagcagctgcttttcctgcatttcttccaaatacaatgatatcaagcagggaatttcccatcaggcggtttcttccatggattcccccaactgcttctcccgcaactaaaagattgtcaattacctttgtaaatccatctccgccaatttcaagtccgccattttgataatgcagggtcggataaaccagaattggcagttttctcatatcaatgccataatttaagtacatacgaagcattgcaggaattcgtttttcaattgttccttctcctccaagtttttcaatcattggagtatccagccatacaccgcttccaagaggagtcgttacaccttttttacgttctgtacattcacgaataatagaagcagcagatacatcacgggtttccagtggatgcataaacgcttctccatctacatttacaagcattgctcccagagaacgtactttttctgttaccagtgctccataaatctgagccggataggcaactcctgtcggatgatactgaatcgtatcctgataaagaagtggtgctcctgcacgatagcctaaaatcaaaccatctgcagttgctccataatggtttgaagttgggaaattctgataatgcagacgacctgctcctccagttgcaatcacaactgtttttgcttttgcaaccagataatcacctgtttccatatttaaaagaacagctcctgcaatctgtcctttttcatctttaatcaactcaaccgctgaagtaaattcaacaacaggaatctgacgatttaatacttcgtcacgaagcgttctcatgatttctgcaccggaataatccttgcaggcatgcattctctttctggatgttccaccaccatgggttgtcaccatatttccttcggcatctttatcgaacattactcctaaatcattcaaccagtgaattgcatccggagcttccataacaagacgtcttaacagttccggtcttgcagcaaaatgtccgcctccaaatgcatctaaatagtgctgtaccggtgaatcattttctttatctgctgcctgaattcccccttctgccatcatggtatttgcatccccgatacgcagtttggtaacgatcataacctcagcgccagcttcatgtgcttcaattgctgcggaagcaccggcaccgcctcctccgattacaaggacatccacatcataatctactttattcaaatctactttatcggttaaaagacgactatttgaatgtaataagtgtactaactctttatttgctttctgacctttatttggtccaattttaatttcttcaaatgcttcttctcgataatccggatgaaaagcttttaaaagggcatctttttcctctgcactcatacgtctaggttccattcccatacgttcttctctggttgcctccacctttttcacggattccatcatttctggtgtaaacatggcttttcctcctatttctcgatttctctgttattataaagttcctgcatctcggtaattggtttctgcataatctgttcaatcaactcatcataagcacctttatgaatttcttctacacgtttctctaagtgcttgctctccggtgcaatatactttccggttaaacgtcttgctaaaaccccaaccattggatgagaaataccggccggacatcttaccgtacaacatccacatccgacacagtcaaaggattcttctgcacacttttctaattcgcctctctgagcataagcaatgtactgcatgacatttaaatcctgcgtacaggctttggtacaggcattacatccaatacaactgtaaatttccggatataattccatcataatctgctgatttggtttaatttcctgaatatcataggttcttttatctgtcgggaagaaaggaatacttgctacatacatgccctcttctacctgtgtctgacaggcaagacaggtttttaattcatttttgcctttaattctataaatcgttgcacaggctccacagaatccatgacgacatccgcagcctctttttaatgtgtatccggcatattccattgcggtcataattgtcaaatctgcaggcacactatatttctttccgaaaaaatatacatttaccatattttccatttgtgggtaccaatcctttcttaatactcattcggtaattcatcaatttcatcaaaacggaataccggtccatccttgcagacatattttgaaccgatattacagcgtccacattttccgattccgcatttcatacgaagttccaatgttgtataaacctgttcttttgtaaatccaagttcctgaagcccagaaagtacaaatttaatcataattggcggtccacaaactaatgcaactttatttgtgtcaaatccgatttcctttaaataggtaggaacaaaaccaacatgtccgtcccatccctcttgttctctgtcaattgtcagataaacattgacatcttttgctttcatccagacttcctgaatttcttttaattgaaccaaatcatctgcggaacgggaaccatataaaatatcaacggttccataattttcacgattatctaatacataattaataacagaacgaagcggtgcaagtccaataccacctgctataaacagtaaattttttccttttagctctgtctcaaccggaaaatgatttccataaggtccacgtactgtaatttcatctcctacttgaagactatggagatactctgtcaacattccgcaacgtttaatactaaattcttgatattctttattcgtcggtgaagaagtaatggagaacataccctcactcacccctggagcacaaaccatcgcacactgtcccggcatatgctcaaataattttccaccttctggcgcattgacgcgaaatgtctttacatccggagtttcttcacgaatatctgtaatgacaccaacttttggaattaaggtatctaatgtataatttttatgacagatacattcgctcattccttgtcacctccctgtttttcaaatgccttaattacttttacgatatttaaagaagaaggacatttttctacacaacgtccacatccaacgcaggaatacattccattattatttgccggatagtaaaccagtttatgcataaatctctgacggaaccgttgcagctggctggtacggttgtttccgtgtgccatcatcgtaaaatccgaatacatacaggaatcccagcagcgataacgctggacaccatgacctgtatcgtaatccttaatatcataacactgacatgttggacatacgaaagtacaggttccacatgccagacatggtttatataatgtttcccaaatcggagaatcaaatctttcttctaaagctcccccattccatccttctaatgataaatttgaatatggaagtttttctacaattttatgaattgctgttttttctgcttctatcttctcatcttctgctttaggactttctattaagcattcttttacaagttctgttaaggcttcccctttttcagtcaacgctttccagtataattcttcttctatcatccaaaccgctacatctgcatccgggctcgcacaatcaatcccaaaagccttacaaaaacaagactcttctggttcatgacaggccattgcgacaatagttccatgctctcttcttgcagagtaaaatgtatctaccggctcacttaagaatacattgtctaatacctttactccctgtacatcacaagctttcatgccaaatacaacaaatttctgttcttttaatgcttctggctcaatggaaagtttctttccttctttttgtactgtatacaaattttcactctgtggaaaaaaagcatcttttggagacttcacggtctttaatgtgtctaaatccacttctgcatctttatcccaggctgcaaaatttacctgattgctgacttttaccggaagatataactcctgttcttcggcaatacgctggaataatgccggaagatttttctttgctatctgatacatacattatcccctttccgttacaatacttggttctgcatcttcaaatgtaaagtttgtaagaggtcctcttgattccgcatcctctcctgcctgatattctccatataattcatcaatatctttaataaatttacggttgaataaatgcagaggaatcccctgtgggcatacacggctgcattctccacaatctgtacatcttcctgccacatggaatgcgcggataatatgaaacatcttttcttcaaaagaatccacattcgctttttgagcactgtcaaattttgtactgtcaaacacacatttacgacaactgcaggccggacatacgtttctgcaggcattacaacggatgcatttacttaactccccttggaaaaaggcaaatttctcttccggactcattgcttcgattttttctacttctgcaaaacgctctgcatctttcgtttctttcgactctccaatgatttcatcataaattttatgttcttttcccttacagacatggcatctttctaacattgcactctgataagtacaggtcttttctccataaatggtctgaattttcaacacttccgcttcatctgtaagctctgcccctgaaatagcctcaatgcctttgatattctgatttttaatcttttcaatatccagtttgcctttacaaccaacgccaacaatataagctttttctctgtttacacgatgttctttgatgagctgattaaagctgtatgtatcacacggttttaaacagaccatagtttttccttctaatttagaagcttctatcatatatttgcttaaatttgcgccacagaatccattataaacaaaatcctttaaagattctacagtttcaaaataagccggttccggattataaggcaagtctccggctttccagccaagtacacgcgctacggtcttatccgcaagcagttcttttgcacggtcaattatttcctgcatcttaaatcctccaatcgtacattttttccaagagaatgaatcttctcaacaaactcattcattgttgttgaaaacttcacgccctccgctgccgatacccattctacgcgggtacgtccattttccactccaatataatcaagcatggaaaacagaagtgtcatacgtcttcttgcataataatttcctgtactgtaatgacaatcccctggatgacatccacataaaatcacaccatctgcacctttttcaaatgcccttaaaataaacatcggattgacacgacaggaacaaggcacgcgaataattttgacatctgctggatagctaagacgactgcttcctgctaaatctgcacctgcataactacaccagttacagcagaacgctacaatcttcggtgtaaactcttcttttgcttctatcgacatattgcatctacctccgctataatctgtctgtttgaaaatccctgtaagtccattgccccggatggacacgctactgtacaagctccacatccctgacacagtgcactgttcacctgtgcaagacgacgcacttcacgaataccatggtcattgacttctttttcttcataagtgattgctccataaggacatacatttgcacacgtagaacaaccattacataaaagttcatctggttttgcggtacatgggtttgtcatcagcttatcttttgctaagagtccaattgcttttaccgcagctgctcctgcctgtgcaaccgtctccggaatatcttttggtccctggcataccccggagaggaagattcctgcggtcggagactctaccggacgcaattttgcatgtgcctctgtaaggaagttattcgtatcaatacttgcagtcaacatcgttgcaatctttcttacatctttgtttggttcaatcgcagcggcaagcactaccatatctgcttctttcaaaatttgtttattatctaataaatctgatccctgtaccaataattttccatttggctgtggaataacctttccaacctgacctttaatataattgacaccgtactgttctaccgctcttcgataaaattcatcaaaattcttccccggtgtacgcacatcaatataaaaaaccgttacattcacatccggatacttatcacgaatcagcattgcatgttttgccgtgtacatacagcaaatcttagaacaatagctctttcctctgttatccgcacaacgacttcccacgcactggatgaataccatttcttttggtgcttttccatcagaaagacgctctaaatgaccacttgtcggtcctgctgcattcataatacgttctaattccaaagatgtaataacatctttactctggctgtaagcatattcatcgtaattatctaatttaatcacatcaaaaccagttgcgacaacaattgcgccgtatttttgtgttacaatttcatctttctggtcataatcaattgcccctgcctgacatacctttgaacaaactccacattttccggttttaaacttaatacagttttcacggtcaatgaccggaacatttggaattgcctgagcaaacggggtataaattgcacttcttgtatttaagccacggttaaattcgctcggtgcttttttcgatggacatttttcctgacacactccgcatccggtacatttatccatatttacacttctggctttctttttaatatctactgtaaaatctcctacaaacccggatactttttcaacctcactgtaggtataaatatgtattttttcatgtgccgctgcttccaccatctttggtgttaaaatacaagcagaacagtctaaagtcgggaatgtcttatcaagctgtgacattcttccaccaatacttggctccttttctacgatatcaacctcatatccagcatctgcaatatccagtgctgtctgaattcctgcgattcctccaccgatcacaagcgctcgttttgttacacggctctctcctgggtataacggagtgtttaaattaacttttgcaactgccgcacgcattaaaataacggctttttttgttgcctcttccatgtctttatgaatccaggaacaatgttcacgaatatttgcaatctccaccatgtatgggttcaatccggcacgctctgctgcttttctaaacgttgcctcatgcatacgtggagaacaggaacagacaaccattcctgtcagtcctttttctttgattgcttttgcaatcaagacctggcctgcttcagaacacatatactgataatcttctgcatgaaccacacctggctccataagagccatctctgcaactttcttgacatctaccgttgcggctatgtttgttccgcaatgacagacaaatactcctattctctgcaccagggttacctcctatatcttctgaatgcactcactaataactgctgtggaagttccggatctaataattccggaatttcatctgctgacaaatacgcctgtcctctttgtctgactaccagctgtcttgctgcatcaatgattctacctggctgtacatctcttggacagcgttctacacaggcaaaacaggaaagacatttccataacgactttgactgaaccaacgcatcaatattttcattaatcacataagatacaaactgatgcggtttaatatccatttcatcaaatgctggacaggatgcagaacattttccgcatttcatacattttaaaggattggctccgctgatttcttttatcttttctgcctgttttttattatcattcatttcctgccacctccctcttggcttcttcttttacgccaagtgcttctgctaaaagctctgtaaaataataaaccggaagtgtctgatttccatttttctttaaattataaaggcaaagtggacaggctgtaattaacatttctgctccaaacccttttgcactgtctgtcactttttttgacatattttctgccatctctttttcttttaaggaaatatatcctccacaacattcgtttcggtatggatagataaccggctcagctccgattgcccgaataaaatcttctattacacttggattttccggattatcgaacgccataatctttccggggcgaagtagtaaacatccgtaataagcaccgattttctttccttttaacggatttaccactttttcttttaatgtatcaaatcctactctgtcacgaagcacctctaaaaaatgaagcacggttgtctctcctgcataaggttcttctaactgcatatagttatttgcccttgtccgaatatcctctacattcttcatatcatcattgacacgtttaatcacatgatgacaagcagaacaaagagttaccaaatcctgacccttttcttttgcctcattgagtgcacgtacggaagaaagttttgtggcaatttcatctgtaccgagcgggtaaaccccgccacagcactgccagttttcaatttcttccagttcaaatccaagcacttttgctgaagctctggcataagcatccaaatcttttgcctttgttctcagcgtacaccctggataataactgtatttcatatcctgttgtcctttctttttttactcttaaatattacatctggattttaatccagattaatctgtgcaataacctctttcaaggcatctgcactcttctttaactgttcaatttctttctgattcattcgcatcggtacttttccctgaattccattcggtccaactaaagtcaaagtacttaaacatacatcttcaattccatactctccatgcatcatagaggatactgtcgcaacagaatcagaagatgccagtacaattccgcataatttgcaaactgcttttgaaaccgcatagaaagtagcacctttatttgcaataatctgtccaccggatttttgtacataagcaagcattgcttctttatccagctcttttacatcttttccaagactctttgccagctcataatactcattgatgctcacaccggaaatataagcccctgtccaaggaatgaaagaagtatctccatgctctccaaatacataagcatgaatatttttctgtgatactttaaagtgttccgataagccacagcgaagtcgggcagtatctaagattgttccggaaccgataatctgattttccggcagtcctgaaatctttgtaaagacataagtcataatatcaaccggattacttacgatgatataaagtgcatccggtgctgcttttacaatctgcggtgcaatgcttttcataatattgacgttggtctgagtcaattcaattcttgtctgaccaggttttcgtgcaatacctgaagtgataattacaatatcagaaccttttgcatcttcatattctccggctacaattgaaatcgggtcacggaaacaagttccctgtgcaatatccatgacttcaccctctaccttttgtttgttgatatcaatcaaaacaatattggaagcgatgtcctcatttgataacgtataagcaatggttgctcctacactgcctgcacctataatagtaattttactgctcatgtttactcctttccccttagataagggcgctcttattgtcttttttttaacaatcgttttttaaaaaaatggaaaatcgtttttcttctcatgtagatttctcccaaaaagcacacgatatccgcacacaaaatggcattttaacgactttcgctctgcgctacctctgtaggatatcatatcgacaagaatttaacaacaattttttaacgattttgatatatttttttcttatggtgctttcgcgtgttattactgtcaagtggatattcgcaatccgcttcgctacttgctcataaccaaatagttgctacgcagcttatcagaaggggcttgccccctcctgatacaagcaagtccccccctgcttattgcttttcgcaattgaagcaggggacttacttgatttggttaaattattattctctctgaaaattgcaaaaaataccgctatccagctaactttgaaaggttctctcatttttctggtataacggtactttttttaatccactaatttatttaattctttcacgtattctgtttcatttgaatttttatgatttgcctgcgctgcatatttcttcactgcattctgagatttcttaatcgactgcatcgtacccgcacctgcgatacaaccaccagggcatcccatgccctctaacagataaccattgtattttccggcttttgccatcataagcagttttcgacagtctcttaaaccctccgcatttgctattttaatctctctttctggatatctctcctgaatcacatttaccacagactgagcaactcctccggaaacagcaaaatttcttccatcctcagatgcatcattgattccttcaacttcttctgttaaagatgccacatcaatatcctttgcttcaaagatacccatcatttcctcaaaagtcaatacaaaatcaacttcactgcgaactgattttctcattgcctctagttttttggcagcacacggtccaataaatacaacctttgcatttttatgctgttctttaatcagccttgctgtaagcgtcattggagtcaatgccatagaaatacactctctgtattccggatacaatttttttgccatagaagaccatgccggacaacaggaggttgccataaacggcagtttatttggaacttcctgtacaaaatcttcagcttcctgtgtcgcacataaatccgctccaatcgccacttcaaaaatatccgcaaacccaagcattttcattgccgaacgcagttttcccggtgttacttttgcaccaaactgccccacaaaggcaggtgcaagtgccgcatatacacgttctcctgactgcattgcacgaatcacctgaaagatttgggatttatcagaaattgctccaaatggacaatttaccaggcactgaccacaggaaacacatttttcagaatcaatctccgcttttccattttcatctgaaccaattgcatccattccacaggctttggcacaaggacgttcctgaacaataattgcattataagaacagacctccgcacattttccgcacttaatacatttttcagtatcaatgacagaacgtccatttgtccgatctaatgtaaccgctttcttcggacagacctctacacacggatgagccaaacatccctgacacccctctgtcacataaactcttttctcagcgcatgcattacatgcaaatttaataatattaatcagcgggggagtatagtacgtttctgcctgatctgccagtgcaatgttgtccgataacggtgcatgttctgctgcactcctgcatggaagtcccattgcaagtctcaaacgttcccctacaatcgcacgctccaggaacacgtcatttctgaaatttcctacttctccgggaataatttcgtatggcaattcttctattttagccgcaacactattttctgtatcataagccatacgtgccacttctctgaaaatcattcttctgatttcttgaattctggtttctacacctctcaataaatccttcctcctgttttttattccctctttgcctccattttaactactctgcttttatttttcaagtcttttatctgttgtatttttttttatacgaaatgcttatctgcggtaaagtaattttccaatctctccaaatttaaatccgaatgttcaatttccctggcataacgataagccagttccactttatcttcaaatgtaagcgttttcttttctgatatccactgatacatccatagttccgtaatccattctactgaaaataaactcagtgccattttactccatattgcatcatcatagactgctccgcaaaaataagtatacacaaaaaacatcataagctgttctttttggatttcccattcttgttttttatcactctttgctccgacacccttctgaaattcttcataaatcctacagtagttctcttctccgtcctgatagagcagttctgccagattttccaatgtcacgctccatgcactctccaaatgttccaattcctcctgtaacactcgaatttctcttttcatacgcgcataccgcgcatggggcgcttctattttatactttttacaaagtagctttatatcctgatttcgatactgctcaagcagagcatcaatttcaaaaaactgattttcatcaactgcttcctgcatcgcttttgccagttctgcacacatccatgctcttttctcaaagtttaagtcacgattttgtataatcgtatacaaaatatctctcgcatcttcaagttgagtaaacatcaaaaaatcaaatgattcaaattcttcctcttcttctgtctcccactccgaaaatgttactttcttttgattttcaagtatcatttctgccgctttgggacaagataaagaaagagaatattcccgcagtccttcatattcttccacatgacgcggatacattttacaggtatcacaaagataactctctccaagctctttttgaatctcacacaaatcttcttcatttaaaaaggcgcaacgactcccatactgaaaaaaaatttcttcttcccaatcaattgaattgcgaatccgattcccaaatggtccggaaagtccttcatatttatcaagagatgtttcgtcaatcacaatctgccatcccgcacagcaggttttcggacaagctccggcaagacaggaaaattcatcataaaaatccggttttaaatatctcatcgtttcttctccttattgtctgtccaatgtataaatcagtttcttcatctgtgtcatccgctcatcaaactgtttataaaaatcgctttctaaatcaaaagccgtagtataaaaacgattcaaaagatacatgctcaactcttgattcagccgggcatccgaaaggcgtaacaacagcgcttttgtatctttcagaaaataatgccactcatttacaaagttctcatactgtttcaaatcaggaatccccagccatttatttacctttacttttgtacgatttgctttggtacattcctgtgactgcaggtaataagaaaaagaaccgtcctcataaattctgccaagcggaaacaaacgacaaaaaccagggcgaaaagcatgaatggtacatcttccctcttcatttaaaaaggcgcatccatcctcttttccctgcatttttaaatttggcagaatcaatccctcttctgcatgaagagaaatcttatgattcaacagttcttcaaatttaacacctaaatgtttgttcatctgataaatatcataaggatctaatactatcgaatctcccatcccgcaacagcaatcgtggcagcctttacagccgccacaatctgcttttaccatatcggatgaactatataatttttttaaatcttccaacaaaacttctcgttccattattttctattctcctcattcttaacctgtacgcttgtaatcactctatatctgattttcaagcctgcatttgcccattttctcttaagttcattttcttaagtatagatggaaaaagaacacttgtaaagaaagagaacaaaaaaatgtaaagcggacattcgcaatccgcttcgctacttgctcatgaacgcagtcgctttgcgatctgtcagtggaagctttcacctcacactgacagaagcatccccctcacccgctgcttagtgctccgcgcacttgaagcagggaaatgcttatctgcgttcaagaaaccacctgcagtttttttctgcttttttgtaaaaacaaaaagagaaatgctacacctgctgcaatccaggacgcaatataaatccagatgatacattccattgtttcaaatgcaggaagtacaaaccagattccgcatacacgaagcaaacagatactgacaagcgtcgtaatcataggagacagggtttctccgagtccacagcacgctcctgacagtgcctctgcaaccgcataaaagaaataaaacggagccatcattctcatataccgaacgactaacggaattaattcaacggcatcttttttgtcaataaaccacggtccaattaaccccgatgcagtaaacaaaatcacacttaaaaatccaactgcgatgatagaaattccagttccgataaaagcacctttttttactctttcatacttacctgccccaagattctgcgccacataagtcgtcatcgccggtcccattgaatctgccaccaaccagattagcatactcaatttgtcacagatactccaggccgcaatactgtccgttcccatcgtatttacactcgcctgtacaatcgagtttgcaacgggaaacagcatggactgaagtgcaagtggaaaaccaatttttatcatcatggacatatgttctgcacaaaaatgcagatgccatacatgaatctgtcctccggcatgctccaagcgtgccaataatttaaacgtaatgattacgcttacaatctgtgcaaaaatcgttgcaattgccgctccggcaactcccattccaaatacaccaactaagagaaaatctccgacaacattaatcaggctgctcaaaatcaatacatatagtggtcgtttggaatctccaaacgctcttaaaattcctgctgccatattataaagaattaaagaccataagcctccaaaataaattcggcaataagttaaagttgctccatgaatgtctgccggcacacgcatcactttcaaaaaccatggagataacaggacacctgcaatagaactaatgactccaagcaccattgcaactgtaagcgccgtacgaatggaacaatgcagattttctttatcctttgctcctacatattttgaaataataatcgttgccccagatgccagtccattcataaagttaatcggaaacttaaacaatgtatttacagaatcaattgctgccagacccactttgccggcaaatcttcctacaataattgcatccacggtaatataaagctgttgaattaaactgcccgcaatcaatggcagtacaaataagagaatcgcctttccgatattcccataaataaggtcatttttcttcatatcattttaacctttcccccatttttttactatcctcacacacacttaccgttttttgcctgattacttcttgtataaatgacacgccacgctatgatcttcatctaattgtatcatagccggacgttcttttttacagatttccatacatttttcgcatctgccctgaaatggacagcctaccggaagctctaacggacttggagcttccccttcaattcctttaatcggcttggaaaagtccatattgatatcaaaaatagaatccatcaacgcttttgtatatggatgaactgcatttttagaaagcatagcacccggaagcacctcaaccacatttccaagatacataactgcaatttggtgagcacactgctgaatcaaggcaatatcatggcagataaatccaattgtaatattcttttcctgctgtagttttgtaactaattcaataatggttttctgtacggatacgtcgagcgcagaagttgcctcatccataataataatttccggttctaatgccagcgcacgggcaattgctactctctgtctctgaccaccactcatattatgaggataacggtctgcaaaatcccctggcaattccaccattttcaaaagccggcgacacactgcatctttttctgattttttaattcttttaaaattaagcaacggttcacagacaatatcacggattttcatctttggattaaaagaagaagtcggatcctgaaaaaccatctgaatattctgacggttttgtcttaattcctctccctttaatttcgtaatgtcctttccccgatataaaatctctccttctgacggagtatctaaagaaaccagaaatttcataaaggtactttttccacaaccagattcacctacgacacctaatgtctctcctttataaaacttcagactgacatcattgtttgcaactaacacacggccaccagaagcaggaaaacgttttgttacatgttttgcttcaagaataacctctttttgattagacaaatcgttcacctcctacggatggtactgcatttaacaaactctttgtatattcattttctgtttcatgaagaatatgttctcttgttccctcatcctcaatttttccatttttcataactacaatataatccgacatgtaggcagcaacacccagattatgggttaccacaataatacttgtcccataattatcgcgaagttccatcatctgacgtacaatctgcgcctgtgttgtcacatcaagagctgaagttggttcatctgccaaaaggagtttgggctgataagtcatccccattgcaattccgactctctgtctcataccaccggataactgaaatggataagaattcataacattgtccggactcgcaaggttcatacgtcctaacatctcgcatccttttgcccaggcttcttttttagagattttttcatgggtcagaatgtactctgtaaatacctttccaacttttctggttggattcatcatcgcaccactatcctgaaaaatcatcgaaatctgtgttcctctgagttttctccactgttcatttgtataagaaagcaaatcctgattttcaaacaaaacacttccctctgatactttaccgccacccgcaagcaagcctaagatggcacgaatgacagttgtttttccacttccggattctcctaccaaagatacaatctgtccctgcttcatgttcaggttaaaatgttctacggtaggctcatttttatatgaaatggttacatcctttaactgtaacatcttcttcctccttactcatctttcgggtctaaaatatctctaagagagtctccaagcatattaaagacaaccacaacgataaaaattgccagacctgggaaaatcataagccaaggtgcagactgaatacaagctcttccttcattgagcatataaccccattccggtgcaggcggttttgctccaaatcccaagaatgacatagaagccagttcaagcatcattccgccaatgtccgttgctgctgtaataatcagtgttggaagtgcatttggaagcatatatttaaagatcatgtgcggtgttttagaacccgtaacaactgctgctgccacatagtcacggtttctgatttttaaaaccaaacttcgaccaagtcttgcatatttcgtccagtttaccacaacgactgcaacaattgcatttttaatacttgcgcccataataccggctacagcaagtgctaaaaccaaacctgggaaggaaagcatcatatctgcaattcgcatgataatactatcgataattccgccaaaatatccagaaatgactcccaaaattgttccaataaaaaagattaatgcaaccactccaaatgtagcagtcaaagaagaacgggaaccataaatcacacgtgcaaatacatctcgtcccattttatccgttccaaagatatgtgccttactcggtgcaagcagagcatcatttaaatctccctttaatgggtctataccaccacttacaatcggtgcaaaaatcgcaaccagaataatcagaaccgccagaatcagaaaaaaagtaaactgcttattctgcgcaaaaaaatttttcttcttcattttttcttactcctttaatctcattctcgggtcaatataaatataagaagcatctacaatcagattgattaccatataaatcaacgcaagccagagtacatacccctgaatcaggttatagtcacttgaggtaattgcagatactgcaaggtttccaagtcctggataggagaaaataacttctacaactgcagttcctccaagcaaagaaccaatcgacaaaccaaacattgtaattagcggaagtaaagaatttggaaatacattacaccagataatacgggaacgttttacgcctcgtgcctctgccccaattacataatcctgactcagttcatctaacactgcggtacgaacctgtctggtatactttgaaaacattgcaattgccaaagttaatgctggaagaaacaggctcttaaaatcccctgcggaactgataaccggaaatatcttaatataaacgcaaaatgccatcataaggagcagtcccacccagaagtttggcatggcacagccgacaaaagtaattcccctgactaaataatcaatccacgtgtctttttttaatgccgatatcattccgagcggtacagataaaatcagcataatcagcatagacattaaggttaattttaaagtcggccaaagtctcacacttaacagttctgtaaccggcttatttaacgaataagaggttccaaaatcaccatgcaggcagtttccaagccatctgccatactgcacaacaaacgggtcatttaatcccatctcttctcttgtctgttctaccatttcttctgtcggcatcacaccatttgcggaatacatatttcgtaccgggtcaccaggtgacatgtaagtcagcccaaatgtaataaaactgataccaaataatacgattatgatttgtaataatcgcatgataacctgtttcttactcaaaaattttcacacctttcataagtctttaatcaaaccactatctctatccatatacaatgcccagtccaaaataagactgggcataatcttaaataaaacgctttcttattctgcgtctgccggaacaatttctgtcgtcagccagtagtaatctgctgtatgaatcttagcatatcctacatttttagaataaatcatactggagttataatatccgtcaattaaaactgctgcatcatcaatcagaatctgctgcatctggaagattaaatcttcacgtttatccggatccatttctgtctttaactcattgaacaacttatcatattcttcattggaatatgcgcagtatgtactttcagttgcccagtttgccatataggcataaggatctccagtacctactgtaatccagttattgttattaaagtcataatctaaggctgccagtttactccactggtcatcagagcttccatattcagcagtcacaccaattccgatttcttttaagtactgagtatgtgcatcagaaaattcatttaacagacggttttcataagaaatataacgcaggttaatattttttccatcaagctcacggattccatcaccatcggtatctacaattcctgcatcatccaataatttctttgcaccttccgggtcataagtataaggattgttcagtttatcatatccataagacagagtcgatggaagaacagaaaatcctggtgtataaagtcctccgattgtcttggaattacaaatggtatcgtagtcaattgccattaagattgcctgacgcagtgtcttatttccaagtacaccatcaaagttcatccaggagaatccacaacgtacacctggtgcaatatctactgtatagtcatctgaatcctggaatttctgaatatctgctacgtttgtgatattttcaaccaagtctacctgaccactctccagagccattgcctttgcagagttatctcccatatacatcagatttacttcgtcataaggaacatcttcacgataatttggatttgcaaccagtgtatatccaacaccgacaccattaaactctttaatcatgtatggaccggtaccgattgttccattatcaaagtttttggtatgttctacatccacaatgcccatagtcgggtgactgagctgtcccatcaagtttgcataaggctgtgttgtctggatggtcagtgttcctgcctcatcatctgcagtgattgttgcttcaaattccagatatttttccggttttgcagaaccagatggtccaacttcttttaagtgttcgtaacattcctttactttacttgctgtcagatcacatccatctgagaattttaatccttttttcaaagtaatgacccattccgtatgatcatcatttaccgtataactgtctgccagccacggagtaacttccatgttatcatcaaatttaaataaagtttctgtaataccgtaacgcattgcattccagccaccgttctcatcccctgcggtatttacacttccgtctgtgtacatggcacaaccgaaatttaaaaccttttcatcactgttacttgatgattttgcagcctttcctgaggaagaagaacttccacatcctccaagtacacttactgccatcacagttgccatcatcagcgctactacatgtttctttctcatttgcttcatccttcctatactggttcttcttcataaattacatttgccttttatagacggggacaaaagtctgcttctttttacgcttttttctgtttttaagcgcaaaaaaaccggataccaaagcatccgactgttaaagattcttaatttgataatagataacgtcaaaaataatctgctattttcttaaacataaatagcagaacgctttttcatctgtacaacttaagcttctcgtcttccgcaagaacttttgttaaagaggtaagcaggtttcctgacttaagcatacacatcaaaagcaccttcccagaataaactatctttccagtggcattttgcttttaaccagctatcacagtgacgggatcgtcccgaattcgcatcgggttctcttttaatcagacgactgtctgaacttatctctgtggcatattcgccaacattctataaataattttatttaacaccattaatatacaagataaatcatctttttgtcaataaaaatatcagataaaaccaaaattttatctgatatttttattttctcttagtcttttaattattttccaagcagttctttctcaattctttctcttgcttccggcgcctgtttatccatcttttccggaaatccaaacatggacacacacgcaatattatcgcctccgactttcggtgcatctgcttttaactgcttatttgcaaaatccatgtctcttaaggtttcaaagattccatcaaaatcaacatctccttctcccattgcaaggtgctgatgaatcgttacatcggattttcctcttgcatttaaccacggtggatttgcaatgtaacggcaatctaaggtctgattaaaggtatccgcaaataatacatgagtcaactcatctcctgcatagcgaagcatggaacgtacctctccttttccttcatcgtagaagaatccatgaggagaagaatagacataacctaaatttctggaacggaacgattttaccatatcgcaggtctcgttattgagttcacaaaaatcgtacggatgagactgaatttctacacggagtccttccctctcaataatcggaagcagttcttccatcgaacgaaaccacatgccattacagatttcctgctgattcgggtcaccggataattcggtattaataaccggaactcccatattcactgcgatttcaatcattctcttccaatttgcaactgccatcttacgctgttcttccgtcggaccggaccaacggtaaactacgatgaaagaggaaatttcaacaccggtttcccgaagtgcttttcgatattcctgctcacactcttttgaaaaaagcggatgtttataaaatggattaattcttggatgtggagactgctcaatatatttatagccccagtctgcgacctgatgaaccatacgattgatatccatctgttttgccaatacgtctacatcaaatgcaattttcatagtcttatcctgcctttcttaaactttataatccacaaaccttgcggatgtacttacgtgccttaattgcatattctaatggatttgcttttgcaggatcctgttctgcctctacaacaacccagccctcatagcctgcttcttctaagatagaaaagattggtgcaaagtctacatttccatctcctggtacagtaaacacgccttctctgactccttttaagaagctccatctctcagctcttgatttttccaccatttctttacggatatcttttaaatggacgtgtttgacacggttcacatattttttcaatacattttccggattaattcctgcaaatgataaatgtccactgtcaaagagtaaaaataccaattcagggtctgtcagttccataaatttatcaatttcttcttccgtctgtacaactgttcccatgtgatgatgaaaggttaaggtcattcctttgtcttttgcaatctttccgagtttatttaaaccgtctgctaagagtttccactcttcttcattcatgacatacttgccttcccatacaggctgttccatttttccctgaatactatagctctgctcagaaacaccaatcacctttgctcccatttctttcaaaaaatcagttgctttgataaattccttttctgtttcttcataaggtttggaaatcaggaaagaagaaaaccactgattgcagatagatatgtttcttaagtccaaagctttctttaacacagctatatcagtcggatattttccgcctacttcagaaccggtaaatccagctaatgccatctcactgacacactgctcaaatgtattctcttttccaagatccggcatatcatcatttgtccacgcaatcggagcaattccaagtcttactttattcttatccagcattttttattctcctttttccttgtttttaatatactccagtatcatagcaaccgcaccctctacgccggtctttgatacatttactaccatgtcatagtgtttcgggtcatctcgtttgattcccgtaaagtgttcataatagtcatttcttaatttatctctctgatttaaatcagccagtgtcattccatcataatattcttctgcctcttttgcacgatagtcatcatctgcatataagaagaaagaataggtatgaggagtttcttttaacacaaagtttgcacaacgacctaaaaatacacctggtgctttttttgcaagtcctcgaatcagacgactctgtgtctcaaacatttctacagggctcatatctccaactgttccggataccgaatacgaatacggcgagaacgtagtttctactgttccataattataagtatccagatatttctggacgctttccaaatccgcattttccattcccatcttttctgctaaaaggcagataatctgacggtcatagagacggcagtttaattcttttgccagttcttctgcaatttttcttccactgcttccatagacacgaccgattgccacatttatctgattttctgaaactgccatagacggaagggcttcttgtgtttctttcccttcttttccttctcttgcaattaattcctgcatcatcttgtcatacactttatccaatttataacaggctgcaattaagagcatcacgacccagattccaatcggcacatacagataaaagcctttaattgctgtaattgcaccacttgtctgttctgctgcggttgcttttaatccattaaatcctgctgctgccaaaattccactcatgattgcagaagtgataccagaacccgctttttgtcccatactcatagaagaaaacatcagaccttctacacgcagtccggatttccaatgaccatattcaatggcgtcacccggaagagaatactgtaccccataaaacggtgcaattccgaaccctctcataatacaggtcaaaacacccagcggaacacttgtaatatttaaaagaaaaattaactgacctataattccaagtgcacatcctgcacaaatcagatttctttttccgtatttcggtaaaattttcggaagcatcgcaattcccacaatcgttgcaactttttctgctgctgagagcggcattacaaggtctacatttcccaatacatactgacaataataagttaagtctgttccgataataatctgatatgcggtatagaaaaccatcaatcccaatgcaatcagaaaataacggtttgtaactgttgtcttaaatgcttttaagaacggaatattttcttttaccttcgctgctgcctgtacacgctcggtgcaagtcatataagtattaattaaaaccagtactgatacacctgcatagactgccgttacaataatccatgccatctgttcgttatggattatctttgccactttattaattaacggaagcgtaaatgcagtaattaccatacttgcagtaatggaaagcaccattcggatgttacagataacatcacgttctcttctgtcacgactcattaaagagcccagtgcgtggaacggctgactgattgctgtataaacaaccgtattcataatgttataagtcacaaatgcataaataatctttcccatacttccaattgacggcatggtaaacagtaagattgccgctatcgcataaggcagagccagacgcaaaatccagattctggcttttccatacttagaatgggtacgatcaataattgttcccatcagcacatccgaaaatccatcaaatacacgagataataacataatcattccgactgccccgacggaaattcctactacatttgtgtagaaataaatcaaaagtgtcgtagtcattgtgtacatcaaggttaatgccgggtcaccaaaacaatatgcaagtttctcgctgaccgaaaccttgataaattcatccatgttttttcccttctgcttaaaattcaacagttcaggtattccgccctttatcatacattttctccttttttcagacaaagcgggtaaaatacccgcctttgtcttctccctgttgttttattcttctcctgttttaagtttactcctatccaaaatatttttgtacaaaacttcttgttacttcggctgcttttttcacattttcttcgtgagacatttcataatattccggacggaattcctcgatagtgcaaactccatcaaacccgatttcttttaaagcagatgcaattccagcatggtctaccaccccttcttccggccagagacgtttatcatctccacaagagccaagcggaaggtcttcacagtcattcaaatgataagcaaagattttcttaccatctgctgctcttaaatcttctaacttggagcacatctcatggaaatggaaggtatctacggtcacacctacattttctctgtctactgcttttactacatcataagccgtaccgaactggttaatggaacagtttggagctccgcaaaattccagagaaatcttcatatctttgccgactctatctgaaagataacgaagtctttccactgcttcttccttgatttcagaaacagttttatcttttacatcaaaacttggtaccgtaattaacatcttcattccaattgctttggacacttccaaaatgaaatcaacttcctcatcaatttctttttctcctgcctcatctctctgattaaagaagattaatgtattgtaagcccatggttttaagtgatgatttttaaaccagtctgccagttcttctaaagtatgttcttttaagtactctctgacacagtcaaaacgaatttcaatataatcaaatccatatttttcacacatttccatatctgccagtaaagactgtcctttacattctaatgctgttgcttcgttaaatcctaatttcatcggttttttctcctttttctgattttctgattctgaaactgtcacatcaactcatcagggacagcttcagaatcttatttcaatttacccgcttatcgtcttatttatagaattctggtttttctactgctgtttcaatcttttcaattgcacctgtctcctgtgcttttacaagcgcatctgcggtaaccgctgcaagatatccatcccatgcatttggtcctttaatcacgccttcgcttgctgcgtctacccagtcctgaacctctgtatcataagcatctttaaatcttacgaagcagtctgtatcaatggtagtggaaacagctgcatttttacggatgcttgggtaaattggagacggcattttaattgctccatcttcacaaaccacttcacagttaatgtcgtatccaaatttgcagtttacaaagacttcaacatcaatgcacacaccttttttggtacgaagcagcataatctgtgggtcctttaattcagaatgagaatattttgttacttttggcataatcacctgagcggattcatattcatcatctactaaccagtgaagtacatcgatttcgtgaattgctgtatcatgaactgccatcggtgtattgtaatttgttccaacttccggatttctgtgtgtgcagtgaagcatcagcggttctccgtattctccggttgccagtgcttcttttacctgcatataacctttatcataacgtctcataaatccaagctgaattaaatgttttccagattccacttctgcatttactacttttaaacaatcctcagcagtggtacataacggtttttcacagaagattcgttttcctgctttgattgctgcaagcagagaatctacatgtgcaaatccaggagaaacaataaataccgcatctacttccgggtcatgaatcaattcatttgcatcggtgtaaacttttgcaccacagatttcagctgcctgttttgcgctttcttcaaacacatcggaaactgctactacttctgctccctgaattttgtttgtcagtcttctgatatggtcctttcccattccaccgcatccaattactccaactcttaacataatttttttcctccatcatctttttatttttttgttttttaatttttatttcgtgtttcatttgatgatgttattttagcatagtgtgcacgtgtacgcaatatgttttttatacaacttaaacacttattttttggacatatttacttttttctatttttaagctcttttcattggtattttttactatataattgattcttgttttggtaatttatttgagatgttctgttaattttttctcattctcaatagtttcttttattctttctttttgtttgcgttcacgtgtacattttaattcaaaaaagaattgaaatttctttttcattattgaaacttcaattctttttagtcttacatattgtatttggttttaattacaatttctgtatactgatactcttctttcggttctttatggtctaagaaaagccgaaataatatcataaccggctcatatccctgcacataagcatcctgaccgattaaaaaattaatcactcctttttccatccattttttattttcactcaagaaatcatttcctattactttaatagatttgccttttccaagtttttccagtgcctcgcagattccctttacggccggaccggttatatagattccagataaattcggatattgttcgattaattcttctacaatctttcctgctacccagtcatcatcgtaagaatatcttgtatgaatcaattctatctctggaaattcatccataatctctgactgaaatcccctcgccctattatttaatgatggattggaaatatgtccggaaataacaacaacctgccctttttcaccgataatttcccccatcaatcctgctgctgttcttccactctggattccgttttgcccaacataacataaacgtttcgtatcctcgacatcggaatttaatgtcacaatcggaatttcatattcttccgcaaactgtcggattttattctttaatacactatcctcggacggcactaaagcaattccagaatactgttcttcataaagcttatccataatttccataacactctgggcatccaccccttttaccggaaatacttccacacttccaccaagactttctacttcctgtttggctgccaaaactccttccaacaccagattcataaacggtgtctgaacggactgcagaatcactgcaatctttacattcttttttgccatagcaagtgcacgtcccgcacggcttggctgatatcccatttcttttgctatttttcggattctttctgcgacttccgcattaacccgccccctgtttttcaatgcacggtcaaccgtccctcttgaaacaccggcggcttctgctatctgctgcaatgttacaggcatatttttccctctcctttaaccttcaatactaataatctcttgtttagctaaaatacgctcggaatctcacaggctttcgccttcagaaatcccgagcgtattttaatcctgctctttttattttactacgtttcttttctaatttccacactcaatgctgatttcattgaatttggccagcacatcatctacatttaatgcttctttttctttcccttttttatctaagataacctttccctgatgcatcataataattcgatttccatactcaagagcataacgaagattatgtgtcaccataagtgaagtcagtttcttttcctttacaatctggtccgtcaactgcatattgatctctgcggttttcgggtcaagtgcagctgtatgttcatccaaaatcaaaaattcaatcggtgtcatagtagacattaaaagtgccattgcctgtctttgcccaccggaaagtgaacctacttttacatccattttatcctctaaaccaagatttaatggacgaagcaaatcctgatagtattcttttcgctttttacgcacgcagaaaccaagattgtaaggttttcctttattctctgccagtgccatattttccataattgtcatggatggacaagtcccaagagacggatcctgaaaaacacgaccgattttagaaaggcgcttatgttcactcatattcgtaatatcctgattgttaatcagaatctttccggagtccacgccaatacttccacagacaatattcagcatagaagtttttccggaaccgttacttcccactaccgcaacaaattctccatcttctactttaaaattaaaatcatcaaacagacacatttcattgactgttcccggattgtaatatttatgaatatgttttaactcaagcatggattttcaccttctttcttcgttccattcctactactaagataatcagaagaatggcagccgtaataaattttgtatccgttgatgggaatccaagacgaattgcaagtgctacgcaggctttataaaaaatagagccaatgacaacactgcttgtcacccttaaaattgtcaccttcttaaatacacttgttcccatgataacactggcaagtccgattacaacggtaccggttcccatagaaacatcaaaataacgctgctgttgtacaaaaatacatccacttaaagctaccagaccatttgaaacagcaagtccaacaatttttaccagtcctttatccactccaagagaagtaataattttttcgttatcacccacagcacgaagcagcataccagactttgtacttaaataccaatccagaaaatacttgctgattaaagtaatgattaagataataatcacagttttataaggaacaagtgcttctgggaaaatcttgtctaccactgcattttcaaaaatattcgaattattataaatcggcaagtttgctcttcctgcaattcttaagttcactgtataaagtgctgtcatcataataataccggaaagtaaatctcttacttttaattttacatgaatcagtccggttaatgctccaatgagtgctcctgccaaaaagcagattggaagcgttaaaagtgaattaaatcctttactgattaaagccgccgtgatggcggctcccataggaaagctgccatctacggttaaatccggaaaatccagaattttataagtaatgtaaacaccaagagccataatcgcataaataagcccttgttcaattacgctttgaattaaagccatcttttttgttcctccgcttattctacttcgatggaatcgaacatttctgctgcgtcagacacgtagctttcatccaatgtaattcctaagttatctgctacttctgtatttccgtaaaagcttggctctgtgattaattcataatttaattcagaagcttttgcctctccctttaatacttttgctgccatctctccagtctgttttccaagagaaacataatcaatccccatagaagcaaggcagccattttttacttgttctacttcagaaccaaaaacaggaatttttgcatcatttgctgctgcaagtacggtctgaagtgcagatactactgtattatctgttaagtttgtaatacaatctactttcgttactaagtctttcgctgccatttctacatcagcaattgtattaataccagtgtctacaatttcaaatccataatctccggccaactctttataggtagcaatcgtactttcagagtttgtctcacttgttgtataaagaataccgattttcttagcatccgggagagttgcacgaatcatctttaactgttcttctaccggaagtgcatcagaagtacctgtaatatttccaaccggggttccatcttctgttgcaagctgtgctgctaccgggtctgaaactgcggtatagataaccggaatctctgttccctttgtgctgttatatgcactcatagctgccggagttgcaattgcacaaattaaatctacatttttagaaacaaagttatctgcaattgttgctgctgtaccggtatctgcctgtgcattatctaagatgacatctaaattcacaccttcttcgattccagcttcctttaaaccttctaaaaatccttcacggcagttatccagagaaccatgctctgcaaactgggaaattccaactgtataggttgcttctttactatctgtaccttttgtatctgcagtgttttcccctgctgaactgtttccgcatcctgcaagtactcctgctgtcattactgcgcttaataccattgctaatacttttcttctcatctttttttctccttttcttgtctctgtattttcttaacaaaaacaaaacatgataggatttacttccgataggagtttctcctatgaaataaaaaaccgcctcaagcctaagcttgagacggtaataaattcttattatcgcggtaccactcaaattaacatttttcatgtccactttacgcatgtactatcatacactccttactgataacgggtttcggctccccgacagtgcctacttattttccatgttcggactgccctcaaaagtccattcagcaaatcaattcgtactgcatttcaccaccgcagctctctgttccttcataaataagcttactactctttctcatcggttttgcttttgttgtcattcattctaatacgaaatgttcggattgtcaaccctttaaagcaataaattttaaaatattggaggcaaaatttttgcccccaatcatcatttctttttattatcttacagtacgaactgctcctatttttaaagttgtactttctttatatggtcttactaacagataaacaaatccagctactaaaaggaatgctacaattgtaccaattccgaatgtaccagctgtgactaaagtaccaatctggtagacacaaagagatacaacataagcaagcaaggtctgatatccaattgcaaaccagaaccattttgcattgttcatttcacgtttgatagctcccattgctgcaaagcatggagcacaaagcaggttgaataccaggaaggaatatgcagcaactgctgtcatacttccggcaaggcttccccagatttctgtaccattttctgcaacttctgagaatccataaaggataccaaaggtacctactacgttttcttttgctacaagacctgtgattgctgccactgctgatttccagtttccccatccaagaggagcgaaaatccatgcaactgcactaccaactcttgctaaaatactgtggtcaagttccaagtcttctaacatacggaactgtccatctacccatccaaagtaagaagtaaaccatactacgattgtagaaagaaggataacagtacccgctttcttaatgaaagaccagcctctttcccacatacttctcagtacattacttacagtaggcatgtggtatgcaggaagctccattacgaatggtgccggctcacctgaaaacatttttgttttcttaagaataataccagagcagataattgctgcaataccaacaaaatatgcacttggtgccacccatgaagcgccaccgaataatgcacctgcgattaaggcgataatcggaagttttgcaccacaagggataaatgttgttgtcatgattgtcattttacggtcgcggtcgttttcgattgtacgggaagccataactccaggtacaccacaaccggttccaattaacattggaataaatgattttccggaaagaccgaatttacggaaaattctatccatgatgaaagcaactcgtgccatataaccacaggattccaaaaatgcaaggaagataaataataccaacatctgaggaacgaaaccaagtaccgcaccaacgccggctacaataccgtcgagaatcagaccctctaaccatggagcacagtttactgcgtctaacagatttccaatgacaaccggcacaccaggtacatcaaccagaccaaacagactccatccgtcaccgaatacgccgtcatttgcccagtctgttgcccaagtaccaactgttgttacagagacataatatacaataaacataattaccgcaaagattggcagagccaggaagcggtttgttacaattcggtcaattttatcagaagttgttactttatctttctttcctcttgtaaagcaatggtcaataatagaagaaatataaacataacgctcatttgtgataatactttctgtatcatcatccatctcttcttcaattttagcgatttcagcagaaacatctggaagattgcttacctgctcgctaattttatcatctctttctaagagcttgattgcgaagaatctcttttgttcttccggaacaataccggaaagtttctcttcgatggattctaagactgcttctacttcacttgcaaatttatgtaccggaatgttgcggtttttcttttctgcaattacaactgctttttctgctgctttctgtacaccagttccttttaatgcggagatttctactacttcgcatccaaggctttttgccagcttgtcaatatgaatcttgtcaccatttttttctacaatatccatcatgttaacagccatgataaccggaattccaagttccataagctgtgtggataagtataagttacgctcaatgtttgtaccgtctacgatatttaaaattgcatccggtctttcattaatcagatagtttcttgctaccacttcttccagtgtgtacggagataaggaatagatacctggaaggtcagtgattgtaacatctttatgtccttttaacttaccttcttttttctctacggttacacctggccagtttccaacaaactgatttgaacccgtcagtgcgttgaacaatgttgtttttccgcagttaggatttcctgccaacgctattgttgccatctttctacctctttccgccctcaggcatttctttctctaatctatcttatgttagtctaccaactattagtatttactaacttagatgcaaaaaaaattaatcaatctgaatcatttcagcatctgcttttcttacagataattcataacctcttacagttacttcaatcgggtcaccaagcggtgctactttacgcacatagacatctacaccttttgtgatacccatgtccataatacgcctttttacaggacctgtacctactaactttactacttttactgtttctccacaaggtacgtcttttaatgttctcatgtctgatgctccttttctatcctaccataattttgtttgccatatcttttccgatggcaactctggaatctttaatatttacaatcaggtttccgctgatctcggatacaactacaacttcgcttccgactacaaacccaagattttcaagaaatcttctggtttcttcttttccaccgactttacggatcacatttgtttctccggtttttaccattgttaaaggcatcatgtttcaccctctcttttgagaaatgttatcattacgtttctttacgttcacagttagtatatgctaacgtgcattagaagtcaagaactttttttgttttttataaaaatacagttgtaaagcagacattcgcaatccgttccgctacttgcttatctgcattcaagctttattgtcataaaatagttagtgtaaatcttttccaaatgtggtatacttataggaaatcgaagaaaaggtggtaactcttatgtatcatacgaatgaatcagctgaaaactatcttgaaaccatacttttattaagcaaaacccgccccgttgtacgctctgtggatatcgctgaggaactcggttttaaaaaatcgagtgttagtgttgccatgaaaaatctccgtcaaaaagaacagattactgttacaaaagaaggctttatttatctgaccgattctggaaaagaaattgcggaaatgatatatgaaagacatgaatttctgacatcctggctcactgctttaggtgtagactcaaaaattgctgctgaagatgcctgcaaaatggaacacgttatcagcaaacagagttttgaagcaatcaaacaacatgtacaaaaaaatcttaccctaaaataagatataaataaataataaaagaaaagaaatgttttgcgaaataaaaaagaggtatgagagaaacaaaaaagaagttcctattttgccggagcttcttttttgtttcaaactttcttgtttcaaatttattatcctttctttttttaatgtctgattgcttttttattgcgcacacactataatggaagatgtttgtgagaaaatttatttctgacactcacatcattttataaggagaaaaaggagaatattttaaactcatgaaacgattattgacttacctaaaaagacatcctctggcaacactctttgctccactttttaaaatgcttgaagcaagctttgagctgtttgttcctctggttgtcgccaaaatgattgatatcggtatctaccagaaaaatgccggatatctgtggcgtatgggtgctctccttgtcctgcttggaatcatcggatttggttttgcaattaccgcacagtattttgcagcaaaatctgctgtttccaccggacgagatttacgaaatgatttatttgcccatatcaacaccctttcctttaaggaaattgatacccttggaacttctactttaatcaaccgaatgacaaatgacatcaaccaggttcaaaacggaattaacatgtttctgcgtctgtttctgcgctccccattcgttgtatttggtgctatggttatggcatttacggtagatgcaaaagctgcgattccttttgtcatagtgattcctgcactggcagtcgtcgtatttgcaatcctgttaattaccatgccgctttataaaaacgtacagaaacagcttgacgatgttttactttccacccgtgaaaatcttctgggaatccgtgttgtacgcgcatttaaccgtcaggaaagtgaaatggaatcatttggaaaaaaaagcagccggcttttctttcgccagattcacgtcggaaaaatttctgccctgttaaatccggttacttatgttatcatcaaccttggtatcatcgccatcttatggtctggcggaaatcaggtttatcttggcagattaactcagggacaggtcattgccttaattaactatatgtcccagattctggttgaattaatcaaactggcaaacttaatcatcctgctttccaaagcaattgccagtttaaaccgtgtcaacaatatcttcgacatgcagccttctattaaagaagaaggagctttcctggcatctaagaccccaatcggaagcattgccggaactgctgctgttgaatttaaaaatgtttcattttcttataatgaaacagcaaaagaagttttaagtaacattacgtttaaagctatgccaggacagacgatcggaattatcggtggaaccggttccgggaaatcaagccttgtcaatttaattccccgcttctatgatgttcaaaacggaagtgtagaggtagacggaggtaatgtcaaaactttaaatccggtttctatccgcaaacatatcggcatggttccacaaaaagcccagctttttaaaggcacgttgcgagaaaacatgcgctggggaagaaaaaatgccactgatgaagaaatttatcaggcactcgaaattgcgcaggcaaaagaatttgtcgattccaaagaccagggacttgacctgatgattgaacaaaacggttctaatctttccggtggtcagaagcaacgtctgaccatcgcacgcgctctggttaaaaatccggatatcctgatccttgatgacagtgcttctgcacttgactttgcaacggatgccagacttagaaaggccataaaacaacaaatacaaaacagaaccgtatttttggtttctcagcgtgtttcaaccatccgcaatgctgatcagattctcgtactcgatgatggtacgcttgccggaatcggaactcatgaagaacttttaagagaaaatgaagtttatcaggaaatctgtgcttcacagctttcaaaagaggaggtgccttacagtgtcaaaacagctaactaaaaaacaatctacattaaaacgtatttttgcctgtattcgtccatacactccattggttttattgtccctgctcttttctgtgattacggttgccctgactttatatgtaccaattttgacaggacacggtgtggatttcattctttctaaaggaaacgtcaatttccatggtttgatttctattatcacaacaatcctgacatgcattgtaatctctgcattatgtcaatgggttatgaatcacattaataataaaatcacttataaaatcgtaaaagatttaagagttcaggcatttaaccatttacaggtacttccgctttcttatgtggacagccatgcctcaggagatttaatcagccgtgtcattactgatatcgaccagttttctgatggtcttttacttggatttacccagctttttaccggtgtcattacaattcttggaacaattgtatttatgctgagtattaatcctctgattactctggttgttgttgtattaagtccaatgtccttttttattgcaaactttatttcaaaaaagacttttattatgttcaaaaaacagtctgaggcaaggggagaactgaccggattaaccaatgaaatgttagagggaattaaagtcgtacaggcatttgggcatgaagaagaaacccagaaacaatttaaagaaatcaatgaacgtctggcaaattattcgcttcgagcaactttcttttcttccattacaaacccggctacccgttttatgtacgcttgtatctacgcaggtgttgcaatttccggatgtttcggtgttatcaatggaatgttaagtgttggtcagctttccagcttcttaagctatactaaccagtacactaaaccatttaatgaaattacaagtgttattacggaattccagaactcccttgcttctgcggctcgtgtgtttgaattaattgatgaaaaaccgatttctgatgataaagcagattctgctgtacttgattcaccaaaaggagagatttctttagaacaagttgatttctcttataccccagaagttccattgattcaaggtctcaatcttcatgcaaatccgggtcagagaatcgccattgtcggtccaacaggctgcggaaaaacaactttaatcaacctgttaatgcggttctatgagattaatggtggttcaattaaaattgatggacatgatattgattcgattactcgtcattccctgcgtgcttcttatggtatggttttacaggaaacctggttaaaatcggcttccatctgggaaaatatttcttatggaaatccggatgcaaccaaagaagaaatcattcaggctgcgaaagaagctcatgcacacagctttattatgcgtatgccagatggatatgatactattctctctgaaggtggaagcaacctctcgcaaggtcagagacagttactctgcatcgctcgtgtaatgctctgcctgcctccaatgctgattcttgatgaggcaacttcttctatcgatactatgacagaaattcgtatccagaaagcttttgaaaaaatgatgcatggacgaaccagttttattgttgctcatcgtctttccacgattaaaaatgcagatatcattctcgtcatgaaagatgggcacattattgaacagggcagtcacaaagaactgctttctaaaaatggattttatgccaccctttataacagtcagttcgctcctgtttaaattaatttaaccaaatcaaggaagtcccctgcttcaattgcgaaaagcaataagcaagtagcaaagcgaattgcgaatatccacttgacaatcatcagataaaaaacctgcggaatctcttgatttccacaggttttttattaacggtttgttcctttttctttctgtttattcatatacatagaatgctctgccttatccataattctttttctcagcctttatttttttgtggtcgaacactcacattgtcaaagaagctttttgttgtacccccccctgaaaaaattgtctgctcctgaaatttcaaataaagcaaagttttctgcctgtttttttaaataagaatctttatccacactcttttctaatttttcctgaatcttatcctgaatttctaccagacattccaaaagcatcggattaaaaattccacattccccgcctaaaatcatttccattgcttttttatgggaaaacgctgccttataaacacgtttactcgtaagtgcatcatatacgtccgctaaagatacaacctgcgcactgattggaatgtcatctccttttaaaccatccggatatcctcgtccatcataacgttcatgatgccatctgcagatttcataagcaatctttaccaattgttcattctgatataattccagattttccagtacggaagcaccgattaaagtatgcgttttcataatctcaaactcttctttcgtcaactttcccggtttattcaaaatcttttcatcaattgcaatttttccaatatcatgaagagaagaagcggttgtaattaactgctgctctgaccaagagagattatatttatccgttttctgctccagtttttccaaaatcatacccgtcagtgtattaatatgtaatacatgaggtccactctcaccatttcgaaattctacaatctggcttaagatactaatcatcatgcggttatttttctctttatcataaatctgatctgtaacaagggttgtcagcctgcgctgttttgcatacaacttcattgtattaaagacgcgctgataaacgatcatggcatcgaatggacgactgatataatccgaaacacccagctcataggctcttctaatatgggcattagaagattcactcgaaatcataataaccggaatatcctcaataaaacggtttttgttcataaattcaagtactccaaatccatcaagtccaggcattacaatatctaacaaaattaaggcaattcctgtaccattttcctcaattaagcttaaacattcctcactattttctgcctctaaaatttcaaaatcatcttttagaatttcggaaagaattgcacggttcatcgcagaatcatctacaatcaaaatctgttgttttgtctgctcttcttccacaaattctcgtactactccgtcacttccaatttttccattttcagagacaaccatatttttctgattttttgctctatacattaaacggtctgcacgacaaacggcactttcaattgtctcatcatttgaaagtacaccgccaatgctgacagaaagctgaagttgtgcatactctggaacttttgcatcatgaattttatctcgaatctgctgcaattctttcaaaaactcatcttcttttacgttcggaacaaccagaagaaattcatctccgccataacgaattaaaatattatccggaccaatgcttttttgaacaatctttccaatcgtctcaagtgcagcatctcccgcattatgacctaaaatgtcattatacagcttaaaatcatccaaatcaatcattgcaacacccattgaacctgtcatctttttaatatgttcctcaaaataacgacgattataggctcctgtcaaagcatctttataaactttttcattgtatctggcaaacttacttacaatcttttcctgtcccgcaacatctatcaaggatgtactgtccaaacacttaaacatttccatcacataaggtgtcccatcaatttctacatagcgcgctgtcacttgataaatatcagaatccataaactccagttttgttttctgagtttttccctcaaatgcttttaaagaaacacaattttcacatggacagtttttattccagaaatcattacaatgaccgtcctggaatttcatcctttcttcctgctcaatccgatgtaacaccatctggtcaatcagacgcacatttgtgaaaatctttttaaactgtctggtttcctcttttgcttcctgcatcgtcatcttgtaatccggttccatactttcttctcctctactggtttctcttaaaaaccttataccaccctgacaactgatggctctttctcctttatcttcctgaattttctatttattatactaaaattaaaatcaattgtctaccaacaaaaaagaaacctcgtaataatagacctctgacaaaaaacatctatcctcacgagattttctctttttaatgtccttttcttataatcgtcttaaaaatcaccaaaatcaaaaagataaccacttcaagcaagacaattgtcccacctggctttatgccaacataataggaaagcaccagaccggcaattgttgtaagcactgcaacacaaatcgcaccaattaaagtatttttataactttttcccatctgcatcccacaggctatcggaacaaccagcatggaagaaacaattaaagctcccactgttcttgaagcaacagaaaccgtcagtgctgttaaaatggtaaacataaaattaatctgccgaaccggaacgcctgaaattcttgccgcattttcatcaaatcccatataaaacaattctcgataaaacagcattaatgtcactaaaactgcaacactgatgatacaaacacctgccatttctcctgtactgatagaaacaatgcttccaaataaaaagctgttaaaatttgcactattttgtacgaagccggataacacacctgcaagcccgattcctgctgacataacaaccgaaatcgccatttcagaatatcttggaatctttttgcggattgcttcgattccaagtgccgctacgatacaagttgcacctgccccaagtaccggattgattccaagcaaaagcccaagtgcaacacctgccaaagaggcatgagaaagtgcatcccctatcatggacattctttttaaaacaatggtaattccaatgcatggtgtaatcacagccagtaaaattccaactatgaatgcacgctgcataaatccatactgcaatatactcatcattcctctataatccttccttcctgtgcattccaaaaccgatttgccccagtataaggcttcaagcttccatgacttaccataagaattgtaagccctttttcatttctcttttgcagaacttcacataaagactgaatcgaaacactgtccatcccggtcgtcggctcatctaaaattaaaaattctggttttcccactaacgcccttgcaagcatcactctttgctgttgaccacctgaaagttctcctatccggcttgtcaaaaaagaatccatctccatctcagacaatgcttctaaaatttttttctgatatttttttccgaaaattccacgcttccagattggctcataaagcccggttctcataatctcctctactgttgccggaaaattttggtttttactgatactgttttgcggtacataaccgattttcattcctttaaatccaccggaaatatctttttcaaacattttaatacttccttgttgtggtatcagttctctcaataacagcttcaaaaatgtactctttccacttccgttttcacctgttaagattacatagtcaccctgtctgattttcagatttacgtcttctaaaaccggtacatctgcataatgaaatgaaatatcatttatctcaaccatattcatgcggtttccctcctgttgtcctatctttccacattaattttccagcgcctttttaatctgctttaaatttgtcctcataacagaaaaataatcttctcctgcatccatctgttcttcgctcaatccctccagtggatttaaaacctctgttttcgcaccaatttctttcgcaattgtattggctacttttgggcttaccagttcttcaaagaaaatggtattgatttccttttttttcgccaactgaataatttcttccattctcgcagggtctggctcagaatccggcatcagaccctcaattgctatctggtttaatccataagctttgcaaagataaccaaatgctttatgtgctacaatgatatctttattggtcacctgggataatgtctcttcaaactcctgatttagtccatccaactgcctgctgtatgtttcataattcttgttataatactctgcattatccttgtctgcctcaatgaaggcatctttaatatgctccatttctatcttcgcattttcagggtctaaccagacatgcgggtcattttcttttccttctcttatcaattccacaccctctgaagcctctactgtaatcaactcagagttatccagtgattttaaaatatcctccgcccaatgttccattcctgccccattgtaaataaacacatctgcatcttccatatttcggatatcaattgcagaaggctcccagtcatgtggttctgttccagatggaaccatattggtaatctctactttctccccaccaatcttctgtgcaaaatcatacatcgtataaaaactggtcattacctttacttttcctgaatcatccgctgtattttttatcgcattctgaccacatgctgtagtacatcctgcaactataactgccataatcgaaagtaatcttactgtctttttcattgcttctcctatctattcttttttacttttgaacttatctatgcaaaattgaaaatcattttcatattatagcaggtatttttgattcgtcaagttttttataccaaaaaagacctctttcgatagattttcctacccaaaaaggtctcttctttccttttcttttcagtttttaatcttcttcaatatgattccgaccctggtcaataatcgtcctcacatgatcatccgaaagggaataaaatacggattttccctctctacggcttttcacaagtttattttgttttaaaatccgaagctgatgagaaatggctgactgtgtcatattcaaagcctttgccaaatcacagacgcacacttctgcttcaaacaagacaaacagaattcggattcttgtcgaatcaccaaagactttaaaaagttctgccaaatcgtaaagctctgtctcttccggcatcatttcttttacaattttcaaaagattttcatgcagctcacaggattcgcaaacttcttctgatttttctgtcataaaacaaatgctatcctttctcttattgatttttagcttttttattctataaattttttacaaacaaggttctgattgcatttaatacggcaattaccataacccctacatcagcaaaaattgccatccacatatttgcaattccaagtgcacctaaaatcagacagagtactttaataccaattgcaaagtaaatattttcatatacaatgcggatacatttttttgcaatcttaattgcctttgaaatcttaagtgggtcatcgtccatcaaaacaatatctgctgcttcaattgccgcatcagaaccaagtgctcccattgcgattccaatatctgctcttgaaagtaccggagcatcattaattccatctccaacaaaagccagtttatctttttcctctttattggcaagcagttcttctacttttgtaactttatccgccggtaaaagttcactgtaaacttctttaattccaagttcagaagcaactgcatctgcaacatttttgcggtctccggtcaacataactgttttagtaacacctgcttttttcagttctttgattgcttcttttgcatgtggtttaatcacatcagaaattaaaatatgtccagcatactttccatccagtgccagatggacgattgttccaacatgactacaggaaacataagaaattccaagtttttccatcaacttttcatttcctgctgcaactgttattccatctacctttgcaaccacgccatgtccgctgatttcttcgatatctgttacacgatttctatcaattgatttattataggctttttgaagactcttactgattggatgagaagaagaacactctgcaagtgctgcatactctaataattttgcatcttccatctcattatgatgaattccgcttacttcaaatacaccacgagtcattgtacctgttttatcaaatactacacattttgtctgagaaagagtttctaaataattggaaccttttacaagaacaccctgattgcttgctccaccaattcccgcaaaaaaactaagtggaatactgataaccagtgcacacggacaactgataactaagaaagtcaaggcacgataaatccagtctccccattccggacttgctcccataaataacagtctcacaagtggaggcaaaatagcaagcgcaagtgctccatagcagactgccggtgtataatattttgcaaatttagaaataaagttttcggattttgattttttagaacttgaattttctactaaatcaagaatcttggaaacagtggattccccgaactcttttgttgtctggatttttaatacccctgacaggttgatgcatccactgataacttcttctccgacagagatatctcttggcacgctctctcctgtcagagcactggtatttaaagtagatttaccttctgtcacaattccgtcaatcggaactttctctccaggctgtactacaataattgtaccgatttctacttcatccgggtctacctgttccaggtttccgtctacttctatatttgcataatccggacggatatccatcagctcgctgatgtttctacgactctttccaactgcataactctggaacagttctccaatctgatagaacagcataacggctacgccttctttataatcgccaagcacaattgcaccaatagttgctactgccatcaaaaagttttcatcaaatacctgtttatttaagattcctttccatgcttttttcagtatatcatatccgattaccagatatggcaccatataaagcgccattttcagatatccatctacaggaagaaaggaaaggattacgagtaataccgctgcaataataattcgggtcagcatctttttttgctttttattcatcccctgctcctccattttctttaaaagtcaacttttttgtaaatttttaaaatctctcccgcaccactaaaagcagttacagaagagactctaaaaacatcagtgagtaacactctttacttttgacactcacatctttttgattgtatcttagaaaaagatttcgcaatcgtcttctacttttttacagtttttcagaacatcctgcatcactgcttttggttcctgaccatcttcaaattctacaatcatctttaaagccataaagtttacagttgcatcttttactcctgcagtatttttagcagcttcttccattttgtttgcacagtttgcacagtctacatcaattttgtaagtttttttcatgatttttctccttttctactcacatttgtttatatgagcacttgttcatatatttgtttgactttattatagcatatttctttttcttgtcaatactaaatttttcattgcatttcttttttttatacactatactttatccggaattgaatttacttctgcaaataaaaacatcttgggaggcattttatttatgaaatacttaattatcggcgcaggcggcaccggaggaacacttggattttatatgacaaaagcaaaaaaagatgtaactctgattgccagaaatgaacatttaaacgtaatgaaatcaaagggacttactttggaaaaattatggaatcatgaaaaagaaacccttccggtaaaagcagtttctatagaagagtatcaggaaagacccgatgtcattttagtctgtgtcaaaggatattccttagattctgtcattccatttattcaaaaaattgcaaaaccagaaaccattgttattccaattcttaatatttatggaacaggtggacggatgcagaaacaccttccggaactttccgtcatggacggctgtatctatgtctctgccaatatttcttcttatggtacaattttacagcatggtgaaattcttcgtgtcgtgtacggtgcaagaacacccgaagaattgcgtccagaattaaaagaaatccaaaaagatttctttgacagttcgattgagggaattttaagtgaccagataaaacgggataccttaaagaaattttcttatgtttctccgattggtgcagcaggtctttattggcaggcaacagctggagaattccaaaaagaaggagaacctcgtgaaatgttcaaagctatgattcgtgaaatttcggaacttgccaaagcgatggggattccttttgaacaggactatgttgccattaatcttgatattttgtctgctcttccaccagaaactacaacttccatgcagagagacgtcatggcacataagccatctgaactgcaaggacttgtctttgaagttgtacgtatgggtcaaaaataccatgttcctgttccgatgtatgaaaaggtcgctgaaaaattgaaagctttaatttaataaaattaataaaaaatactgccggactgaaaaaataagcttcagccggacagtatttttttatttaagaaatcaatcaattaaaagtttaagataataaattattcatactctttaatgtgataagtaatgttgaggtattatgaagcagtgcagaagttgtcggcatgataactccgctgactcccagcagaatcagggaagtgttaattcctacaatttgacgataatttcgtttgattcgtttcatcagaccattactgataaatttcagtgtcacaatctgatataaatcatctgcgctgattgtaatatctgcaatctctcttgcaatctctgcaccatcactgattgcaattccaacatctgcagcagaaagtgccggcgaatcattgattccatcaccaatcataatcactttttttccatttgctttttcattttctacaaattttgctttatcttccggaagtacttctgagaagtactggtctactccaacccgctttgcaattgccgatgcagttctttcactgtctccggtcatcattacgatgttagaaattcctgcttttctaagagaattgataaccgcctcagcttcctcacgaagtgggtcttcaatacagataacggctgccagtttattttcaattgcaagatataaatgagagtattcttccggaagtgctgcaaattctgcttcttttccagccggaacaacacatttttcatcttcaaatacaaaatgatggcttccgataattactttcttaccttcaattgtacttgaaataccatgtgctaccatgtattctactttagaatgcatctcttcatgttcaagatgtaatttctttgcttcatttacaactgcttttgccatagaatgagggaaatgctcctccaaacacgctgcaattcttaacagttcgtctggattttctccgttaaaagaaatgatatctactactgtcggttttgcttttgtaagagtgcctgtcttatcaaatacaatggtatctgcctctgcaactgcctctaaatattttccaccttttactgtaatattataaaggcttgcttcacgaatcgcagaaagcacagaaaccggcatcgcaagtttgagtgcacaggagaaatcaaccatcagcaccgataaggcttttgtgacatttcgtgtcagaagataggtcagggctgttccacctaaagtatacggaacaagacggtctgccagatgctccgccttgctttctgatgcggattttaatttttcagaatcctcaatcattgtaacaattttttcaaaacggctagaaccaccaacttctttcacacgtactgtcagttcgccctcttcgattacagttcctgcatagacagaattgtgttctactcttcttaccggtacggattctccggtcagagacgcctgatttaccattgcttctcctccggttaccacaccatcaaacggaatgactttacccatacgaactacaacttcatctccgactttaatatcagaagcagaaaccaaaatttcctggtcatctttcttcatccagaccttcttcacatttaaggataaggaacgagccaaatcatctacggatttcttgtgtgtccactcttctaatagctcaccaattccaagcaggaacataacagaacttgcagttgcaatatcatcacgaagaacagaaactccgattgcggttgcatctaataccgcaacttcaagttttccggtgcaaaggctacgaacacctgcatagatgtattttaaagacttaaatgtggtataaatggcacgcaccggaaatggaatcactgcttttgcgatatatctgcatgcaactttcgtaatcagtttttcctgatagtctgcatttaattttcttccggaattcgcaatgacttcctgcggtacatcggctttttcataagaaaatgcacgtaatgctttaatgacttcctctctgtctccgacataagaaatcgcagcgtctgctgttctctcatatacttttacaaaactaacctgtttattctggtgtaaataatataacaaagtatcagcctgctcataactcattcgtttctgcataagatgcacacgcattctgccctttgtctcatgttttatttgaaatttcatttgcatgtcctctctttatctgtatagaaaagatatcaaaacacctgcagagatctgcaggtgtttaccaacttaaaatgaatgaattattcttctgtttctgactctacttctttgaattcttcaacagcttcttctgtttctgcttcttctgtttcttctgcatcttcaaattcagctgcttcttttttggctgctctttcttcatttacatttttggctgcttcatagatatcttctgcattttcctgaaccattgttacgactttcataacgcagtcttttgctcttaaaacaagagcagtgccctgtgtatatacgttctttgcgtcatcgcttgataatgctttgattcctgctgttccaaatgctacacctgctgcaaaaattccggtttttttccagtcaatatttttcaaacaatttaacatcctgtattcctcctgctatttcgtatttttttgtttaaatgacattatacaacacctttttttacttttccagcattttccttgttattgagaatttttatcacttttctttaaaatcacaggcgttctatgtaaactttatacttttgacacttacatcatatgatgattttttttacacgctgacctttttttgcatagccacaagcttctaaaccagcctccatcacctttttccacttttttgaagtcagcttgcagacactgttatcttccagttcaaccatacagcttccttgttggggatgtctctttgtctggttttcaattttatacatattttttctgcttatgacacccatttcttcaagtttatttaccatacgatatacggtagccactcctatctcagggtctttctgcatggcacggtaataaatttctttgcaacatgaacagtctccttcaaggataatatccagcaccagctctctttgtctggtcattcgtccgccctttgccttaaatttactcacaattctatctttctgcatttgggtatactgatacaaaataaaattttctggttcttctatctgtgtcttaccagacattcctatccctcctgcctgttcaaacttctttcattgttagtgtatactaacaactattagtagtcaagaacttttttataaaaaaaacgccgtttttctgtttttctccagaaaaaagacgttttctattctttcttatctttttttaactaattacttattaaaaattctattcttactttttataacaatacatatttcagtacaaacaagactgcaagtacatacatcagcggttttactttctttgcttttccgcaaactgcatttaataccacgtaagaaataatgccaatagaaattccctctgaaatactgtagaatagtggcatcgcaataatacacagataagcaggaactgcctccgtcatattatcatctgtaaatttgatatcggtaattgcaccaaacattaagaatcctaccataatcagtgccggagcagttgcaaaagatggaattgctgtaaaaattggtgcaaacagcatggaaatcaggaataaaaatcctgttaccactgctgtcaaacccgttcttccacctgctgcaacacctgccgaagattctacgaacgtagtcgtagtagaagttccaagaactgcacctgccgctgttgcaattgcatcagacatcagtgccggtttgattccaggcagtttcccatttttatccaacataccagcttttgtgctgacaccgattaaagttcccaatgtatcaaataagtcaacaaacaggaaagaaaatattacgataataaagtttacaattcctaccttatcaaaatttacgttaaagcactgcccaaaagtttcacccagttttgaaaaatctgtcattgcaaaacttgggaataaggtataatatccaagttctgcattcggaacatagattccaacgacctgacaaatcattccaagaatccaggtagataaaattccaactaagattgcaccttttacatttttgatataaagcacaactgtaataaacagaccaactactgcaagaattgagcagattccggcagagtggaagttttctttaaaatttgtaattgttacaagtgtagactggtttaatacaaccagctttgcgttctgaagtccgataaatgcaataaaaataccgataccaacagaaacacctttctttaaatttaatgggattgcatcaaaaatcgcttctcgtacattggtaagggaaagtacaataaaaataagtccctctacaaatactgcaagcagtgcaacctgccattcgtaacccattacaccgactacggtatatgccatataagcatttaagcccattccggcagacagcgcaaatggaagatttgcatacaatgccatacagattgttccaataaaagaagcaagacatgttgcaagaaggactgctgttgcatccattccagcagcactcaatacacttgggttaactgcaaggatatacgccattgtcataaaggttgtaatacctgcaattacctctgttttgactgtggtattgtgttctttgagtttaaattttttttctaacataattgtttgcttttttaagcacgctctcctttcttttggtttaattttcttttcccacttcttaataatacagggaaatccgtctctgcgtcaatataaaacagataattcaagcttaatttctgttattgtaacatctttaataattccggcgcatattttgaaactactagccaaaaggaagcaatcatcgccactgccgaacccaaccagaataacaacgtattgactattccatctgccgtacatagtctcaggcaccagccatttccccacggataaagcagacgcacttttcgtttattaagtaaatcaatcataatatgggaaagcattgcaattgcaaaatagagttccacttccggatacataaatgccacaattccgctaaaaatcaacagacctaaaatagaatgcataaaagatcggtgtggctgattctttccaaatgtacacacgataagcatcaccgcaaagcctatgataaatcgaaacaaactgctttctctgttaaaattcttaagaattcccaagtgaaaaatacattccagtattaccacaactacaaatgccagacaggaaactgcagtaattttattaagcgcttcccttgagtctgacgtactgacatccacatcactgattacagaaccaacaactgccgctccgatgcataaaacccagtctcttaaatggggcggttgtgtcacgcataatgccgcagcagttcccaccgccaaatgtgtttttcctgtcatctcttttcctttctcctttcctaaaatctgtaatcttgaagtttttcttattcttccgagactacctgaatcacagccgttttattatactctaccacacaaaagctggcaagcaattccgcctaaatttcgctgtttttcttgcatttatgcccttctggacttataataaaaccatattacaatggataatccaaagggggattttacaatgaatcatgaactttatgaagaggcaattcattccgatgtcttatctgagaaacttatcagtcagctcttagaaagcatggaatacagcagtatttcttttattaactggagcattgaggtgctcaaattaattcgtgttcgtattgaacgcggcgataaaatcaaagatgaagtcagtggagaaatctatacgaaaaaaagctttcacgcttttgtaaaaaaacatttttcttcctatattgaaagccaggtatttgcagacccggctaaagcggaaaaaatttatttttcactcgaaccatgtaaagacggtgaatacaatctggttatggcagaatcttccaaaaagaaagtctatgaatggatttcctctttaaatgaacgcttttcactggtagaaatgatttcaaccggaatcgtttatataaaggacattcgttctaacacttatcagccttttatttctaaaaacggaaaatactgccattataataaagaaaccggacatattgttgaagtttaaaacccaaaaatcctcaagcagacactatctgctcgaggatttttttcttacctttcattcttatttcttctcttctaccgcctcaagacctccggttacagaatccataataaatccggtaattttaattcctgccggcatcaaaggatgatgtttcaacgcatatacggtatcttttacggactgttctacgctttcaaatccacctaaccatttttccaaatctgttccggtactcttaattacattaatgtgttcctgtgaaactcctctttctacgagttcctctaacatgtgatgtccatccattccctgtacaccacaatctgtatgaccgattaccataatttcttccacaccgagttccaaaattccaactaacagacttctcatcacacttccgtaaggatgcgtaattaccccgccggcatttttgataatcttagcatctccatttttaatgccaagtgccgctggcaataattcggttaatctggtatccatacaggttaaaatcgccagtttcttatccgggtatttacttgtcaaataaggctcatacgcttttttctccacaaactccttgttgtactttaaaatatcttctatcatacgcacacaccgttcctttctttccaggtttttcctgtaagagtctgtctttattataaactttttttcaccctgctacaagcaaaatctaggagaatctgccaactctgcaaatcccccttttttcctcaaaccagatattttcttaaaatcttcttcatttattttaatgttcttccagccagcgtcttgcacagtgtgccagacagcctgcaccaatcgggcagacctcttcattaaactgcacctttggatgatgagcaggatagtcgcctctctcatcaagataaccagctgacaaatataaaaatgaacttggaaccttttccgcaatgactgcaaaatcttccgatgcacttgaagagacatccggatgtggaatcagattcggaatctctaattctttcatatatcccactacttcttttgtaagttcagaatcacaaatcaaaggcggtacttctgaaatcatctcaattgtcgcacttcctctgtaaacttctgcggtcttttccaccacttctttcattctttttactaaaagttctcttgcttctttttcatttgtccggatagttccctgcaacacagcagtatcgggaataatatttgctgctgttcctgcctcaaattgtccaatcgtcaatacacaggaatgacttggattacattctctcgcaatcaattcctgcaaagccagatggatatgcactccaatattaatcgggtctactccaacctgaggatatgctccatgagagccctttccctgaattgtaattttaaatccatctacggaatacatcattgtattcttgtcattatacatatagagtccgaccggaaatctgcctggcgatacatgataagcaagtgctacatccaccttcggttcttctaaaattccatgttccaacatatttttacttccctggaacgtttcttccgccggctgaaacatcagcttgactgttccctttaactctgcttcctcttcttttaagatttttgctgcacttaaaagcatcgctgcatggaaatcatgcccacaggcatgggctgcccctgttttactcgaaaatggctctccactttcttctttcatcggaagcgcatccatatctgctcgaagcagaataacttttcctccgtttccgattgtagcagttacgccctctccacattctacaggctcaattccatactcttttaattttttcatcacaaatgcttttgtctctggcagatgcagacctgtttctgcattttcatgaagaaaccgacggtttgcaatcgtttcttcctttaattccagggcatgttcatattcattcatagtcatctctcctggttttcctaaaacttttcttttttatttttctacaaatttttcttttaacttggtcattttttcagaataaacctgttcacgttttttctgagcaacttcattcataacctttactttcacttcttcaaatggtgcttcacatgcttcgtttttcttttctactttaattaaatgataaccaaactgagtttttaccggtcctactacttctccgatatttgctgcaaatgctgcatcttcaaattcttttaccatctgaccttttccaaactgaccaaggtctccgcctctctgagaagatggacagcttgaaaattcttttgctgcatcctcaaatgttttttctccattctgaataaatgtcagaatttctttacatttctcttcagaatctgtcagaatgtgttttgcacttacagttgcacctttctgataattgtgtttatttgcttcgtagtatgcttttgcttcttcttcggtcacatttacttctttcatgatattgcgaagtaccatctgtgctaagatatcctgttttgctttttcaatctgtgtcaaaaattcttcagattcatctaatttttcttcttttccttcttctgccagtacatacagcgcaattatctgttctttgcagtagtcacgaaactgtggctgtgttgcataaacctgctgttctcttggcagagtctgaatgtaatgtgttacttcctcttctgtgattttgtgtcctgctacaactgcaattacgttttcttccattttaaagtatctcctttttgtgataaaaaattccggacagtacctgtaaatactgtccgggaccaaattactgttttattatatgaaattttcagctctttgtaaagattatttgtatcgttttatttattggaggatttttcatttaagattatttgtctaagcttcttcgtattaatcgttttttacgttaaaggctttgatacccggataaatagctgcatttcccagttcttcttcaatacgaagtaactggttgtattttgcaactcgctctgttctgcttggtgctccggtcttaatctggcaggtatttaatgcaaccgctaaatctgaaattgtagtatcttctgtttcaccagaacgatgagaagaaattgcagtataaccagctttatgagccatcttaattgcttctaatgtctcagaaacagaaccaatctggtttaacttaatcagaatagaatttccgcatccaagttcaattccttttgaaagacgttctgtatttgtaacaaataagtcatcaccaaccagctgtactttgtctccaagttctgccgtcagtttcttccagccttcccagtcctcttcatctaaagcatcttcaattgagataatcggatatttctctacaaggtttttccagtgtgcaatcagttcttcagaagtaaataccgtaccggcttttggaagtttgtattcgcctttctttccggttttccattcagaagatgctgcatccattgcaattttgaagtcttttcctggttcataacctgcttttttaactgcctctaaaatagtttcgattgcttcttcatcagattttaatgctggagcaaatccaccttcatcaccaacagatgtcgcaagtcctctttcttttaaaatagaagcaagtgcgtggaacacttctgcacaccatcttaaacattctttaaaggacggagcaccaaccggcataatcataaattcctgtacatccagtccggaagataatgcatggcatccaccgttaataatattcatcattggtaccggcagacgatttccggaaattccgccaaggaaacgatacagaggaatatccagtgcatttgcagctgctcttgcacttgcgattgatacagcaagaattgcatttgcacctaacttggatttgtcttttgttccgtctgctgcaatcatagctccatctacagcatagatgtcagaagcatccagtccatgtaaggtctcattaattgttgtattaatattttcaactgccttttcgacaccttttccaaggtatctttcttttacattatctctaagctccagtgcttcaaattctcctgtagatgctccacttggtgccattcctcttccgatagttccatcttttaagatgacctctgcctctacagttggatttcctctggagtccaaaatttctcttccgattactttttcgattgttaaatgactcattgccatgtctcctctctgtttgttttcctctcattttacaactcctttaccggaagcttggtatcttccggtgaagaaagactcaggtaatcttccttcaaaggagttctaaaatgattcagtcacacgaagttagttttaactaactatttgtattatacaaaaagaagaataaaaatgcaatcccctgaaagtgatagtttttatcagtaaatttctgattctcttcttttaacagtcattgaacttttacaaagccatcttatcgaataatgaaattcaatggctgttcttctaaagaaacttctactaccttttttactcctgcgttttccccgtctgtatgaatcggaacagcctcttccattgtcagtactgcctttttacatctttcaatatgtaccatttttttaaatatcacatgctttccgaaaaatgccgttggcagtacacatagaatcattaactttggaagtttttctaccagacaaatatccaaaaaatcatcacagggttctgcctctggacaaaacaaaaatccaccaccctcataacgagtattcataaatacagaaaataaaattcctctctgatattcctttctattctgattatctaacaccagttctgcctttgtatagggatatttcatcaacaattttaatgccgtaaataagtaggttaatttcccaaaatgtaaaaagtttaacatgtttttgattttcgactgaatcgaatgatggcagactgctgcatcaaatcctgctccgctgctgattataaaccttcttttttctccctcttcttcctcattatctttagttacaatttttccaattcttaccgcttttttctcttttggatgaagaataaaggctaaagcttcaagtggctcttttgaaagtccaagtccccttgcaaggtcatttcctgaaccggttggaatataaccaaaacttaaaaatggagataagattaatccatttaccacttcatttactgtaccatcccctccgattgcaacaatggtacatggattagtttccgaaacctgcaaagacgcctctcttgcaagacgctttgcatcacctgttttctttgtagcagcaattttatagttaatctcttctttctctaactgttcctttatctctctccaaagcgttttatgttttcctgaacttgaagaaggatttatgataaaatagtaaaacatggtattattccttttcctttgttttttcttttaactttaatcagaattgagagatttttcaatagaaagtttatgtaaaagtttatggatttggaaaattaaatttgggtaaaataaaaagagagcggaacaaaaagaatctcatcttttcatttccgctcttctttatttttcttattctacttcttccggttccatgcttcgcagatgttctttgatttctccgatatcatatttctgactatattcggttaaataagaataatactccgtattatctgccggataaatctttgaattgtgaatatggatatcagaagtatcttctccactcttcatcagtgctaccatagcacttgcgcagtgagatgcgatacgtccgaagctatttaaaatatcattaaatacggttccttcttccagaccacattcacccttgcttaaacgttctgcatggtgcattttcaattcgtcacatgaccttgtaataatcacgccaagtggtgcaactctctgtgccagctctctgtcatcatttacaaacgcattgcttgtaatattaatcacttcacgaaccgcttccataaccacatttaattcatcccaggctgtttctgaaaactctgtatgattttcatgcatttcatttgacatatatccaatataagaagcatgatcaccaattcgctcaaggtcattaatcatgtgaagatataaagaaacctgcttcgtctgtgccgtgttcatctctctttttgtcaactgaacaagatattctcccagacgactctcgtatttatcaatcaagttttcttttctctgtactttattgaatttatcctgctcatagtcattaagcagattcattgcacggtttacatttttgcgcacttttttcgacattccgttcatgacacgatgacactgtgcaatggcaagcgccggataattaagcaaacgttcttccagtaaatcaaaatcttcttcatcttccagttcttccgcactgtcttttaccagccagcatactaatttttcaactttggaaataaacggaaacagtacaattacggttgctacacggaatacagtatttaacagcgcaatggctaccggtgtcataatcatatccataaatgtaaaatgcacaatcgcatttacggtataaaaaacaatggaccacaaaatcagaccaaacaagtcattaatcagataaacaagtgccgttctttttccgtttttatttgctccgattgcagagatcaaaaccggacatgcagcaccaacaccaattccaagtacgattggaaatgcacttgcaaaggttaaaattcctgttacggataatgcctgcaatacaccaacggttgccgatgcactttgaagcactgcggtaaataaaataccaactaaaatacctgcaattggatttgaaaacatcgtaagcatgtctacaaagaccggattttcacgaagtggtgaaaccgctccactcatcatctgcatacctgtcatcaaaattgcaaaaccaagcatgatatttccgatatttttatgtaccgtccttttacaaaccatgcgcagaattgtaccaatgactgctacaactgctgaaattgttgctgtagataagacttttgcaattccacttgaaccttcaatataggaaagacataaaatccagcccgtaatacttgttccgatattcgctcccatgatgataccgattgcctgtctcagtttcatcataccggagtttacaaaaccgattaccattactgtcgttgctgaagatgactgaataacactggtaacacctgttccaagtgcaactcccttaagtggagtattggtcatcttgtacagaaaagcttctaacttgtttcctgcaaccattttcagaccgtctcccattaaggacataccaaacaaaaacagggaaactccgcaaagcagcgacaaaaccattgaaaatatttccatacttttctcctcttttatccgttttttctacctatatcttaatataaggatatgatttctgtcaaaaacaaacgaatttaacattttcttaacctattcttttcttgtttttaacattttcttttttattatgccacatcacctcaatgattacaatctctggattgtcgaaaaaacaaaaaaatttttacaggttctccattattttctacaaattttaattttttaaacatttcctattgactaacacacaaatggatgctctatttatagaaattataccgattttcacttaaataaaaaatcctgtacgatacagctcttcaaagcatatttcatacaggattttctttatttagataaattcaagagatttacttttccattttctgttttacatcggatgcaatcgaaaccgcagcattaccataaggaatccaggttgcctgaaatgcatgatacaaatctgattttcctggccataccgtcccaatcacttcatttttctcattcaactgatgaaaccaggaaccgttttcatggtctaataccttttcatccagatatttcataaatttactataatcctctgcatatctccggttgtttgtaatctgccacagtactgaggaagtattaattgcctctgccaaagtccagtgcatcctgtcatgaatcaccggatttccttcccagtcagtagtatagacaagtccctctgcgccatcgacattccaggcatcttttatcgcacgattatataaagccttggcagcttctacatattttcctgtcaaaatacttgaactttctgtcctataagtagaaagtgcccactggctgattaatctcgcccactcaattccatgtcccggagtcgcaccataaggtttaaactggtctgccggctgttctttattacactccaaatcttctttccagtcttttgtaaaatgttccggtattctaaaggaattttcagagaaccattttatcacatgttcgataatccctcctgccctctgacggtatttctcatccgagagtgcatcagctacagccaaaaatgcttctactgtatgcatatttgcatttaatccacgataatcatccaaaaccgtaaattccgtattccaggtatctacgcaaagtttctctttttcatcccagaagcgcaaatcaaataattccaaagcttcttttaaaagttcctctgctccatcaatctttgcaagcatggcagacgatgcagataaaattacaaatgcatgggcatagcactgtttatttggcaaaatttcaccatcggcgcgaagtccgctgtaccagcccccatgttcggtatcctttaacgctccttttaagccttttaatgcgctttcagctaatgccttgctccctttatcaccaagcatcgttccaatgctgtatacgtgcagcatacggcttgtaatccatgtctcacgatttctgtctttccatggagttccatcatctccgagatagtaagaactgccatctggcgctggaaactgtcgcccaaactccaggagattctttcttatctcttctaaaaactccttattttctttcgtacctatctgatattttctattctcaccttccatttacaaaaccctcccttttttcgtgtactctcggaatttttatgcctgttttatcatgcagtattgttttaaatgaaagccttttttttgcacgactccatataattgaaagccaaatttttcatacatcgccacatttgccggattatgtgtctcaagcgaaatcattaatttatttttatatgcataatcaatcacttcatccatcagcttttctgccagtccatgatgctgagctttcggtgcaaccgcaagataaatcacatgaagccgctgattgctatgaagctgggaagtccagcttgaattcaaataatcctttccctgaataaatttccaaagtgttgcaagactcgggtcttccttaattaaatagctgtctgtctttaagaccgcaaaaaaatccactaaaagattatgtaacgctgcatcatgttccgttccatccgagacaacaagaatgctgtttaattcgctgctgtctgcatagatttcacaggtttcaaaaaattctgtcaaatcacagctaaacagttccggcatcagtctttctctcgtctccttatctggaatcaatgcctgatacagcggatcttctgcaaaacacactgttaaaagacgaatcagtttttctaaatcttcttctttgttcactcgatataaatttgagctttccatattttcctccaggtcattttaattttcctcaaacagtacaatcgtttcttgaagcatctccgagaattttgtaaccgcacgaatcaaatactcaatatcatccttgtaatatgcgcattgacgctcccatacttcctctaagtgcctctgctccagttcaagactgtctttatctatttctttatttttcagcctttcgaccaattcatatagattttcatgatgcagaatccttcctttgccccacatcaaacgttccggctcttgcttcataatatattctgtaaaatgataaaacacttctttttcaaattcaaatgcatagcagttattatcaatactgtaaaatgcatccaatgtttcctcaatatttccggcatttaatgcagtcttcgctttttttaatgcatgcagattattctgtactgcctgctgtggaaaaatcactccatcatcccagtctaaccgcacaaaataatcttgcgctttcttaaaaatagcaagcagtttttttgttattgcatctgcccttttccagtctccatctgccccaaaattctgattccagctttgtatcttttcatagagacaaattgcagtttctcttgctttttttgtctgctccaaaagcacacttccctctgcacctgtttgtttacacacattcaaatccagactgtccatacttgcagttaaaacagttgcgaaattaagcggcggtaacgccagagcatcaacttccatcaaaagcttaagataaaactcatgatgaaactgatacacctcctcctcatacacgtcctgattatcatattgtgaatgataataattttccataaacggtccgccgctgaaatcatttacaaaagacgggattcctgaaattgccattgtaaaatcatccgaccaggtttctatcggatataacgttgtcattccatctggataaatcccttttggcatcgcatctttatccacaaacttttgaataaaatcaacatactcatacgtacagcgtatcgcatctttcgtactgtgagcatgtgccggaagttcaaaattaaaatccgcaatgacgtttcccggccaatccgctcttgcctcaaaaacctgacggtaagcccctgtagaccagtcatattttgtgtcagaaatcccccactcctctgctgcaagcgcacaaaccacaatggtatgatttggctgataaccaccttgaattaaagcttttgcaattccgattatcattgcaactgctgcattatcgtcctgaaatccttcaaaataagaatcataatgtgcacttaaaagaatcatagaatccgaacgttttcctggaatttttccaataatattataagtgtactggtctttctctacttttgtctcagcatccaattccaccaaaagatggggcacactgttttcttttttattctcatttttactctcttgcatcaattcccaaatttctaaaaaatctgctcttgacatagaaaaagcgggagctgatgccggtcctgcaatatcctgtgcattcaaagccgtatcatcaatctgagcatatccgcggctttgcacggcaattaaagcttttgccccttttaaatgtgcctgataaaccggataattaatccaccactcctctctttgattaatttcaattaagaccaattttccttttacatctatattctcataatctttggctgttccttttttcagataaaccaggtcaaatctttcaaatccatctgtcttaaaatcagtctgatatgcccccaattgaatttcttttttctcgcctgtcttagtctgatagcgcatcactgcctttttaaattcccaggcatcgactgtaatcttgtctttatgtacgtcgacaagacctgcttttttcatttcttcaacgagcatatcccccgtttttcgttctgccaaagaacctgctgtacgatagcccaagataggattcgttttttctttttccattcgtcttgcaagctgataagactcttctacctttaagcaggaaagacaattttttaaagcctcttgaaaacttgagttctccatttttctcatcttctttctacgttttttgtctcttccaatcatttctttttctattatacgcttaccagtactcttgtcaatttattgcgaacccaaaaacaccttatctctaaattaaaaaatgacaaaaactctgtctttttttaaccaaatcaaggaagtcccctgcttcaattgcaaaaagcaataagcaggtgtggggacttgcttgtatcaggaggggcaagccccttctgataagctgcgtagcagctatttggttatgagcaagtagcgaaagcggattgcgaatatccgcttgactacacacagtctttgccatttttaaaccaaagtatttttttcatatttttttctataatttttcggagaaatttccatatgctttttaaaacaatttgaaaaataaatttccgaaccaaatccaaccagtcttgaaattttccgaatatcataatctgtccgtaataaatactgctttgcatactccaagcgaatttctactaaaacctcaagtggtgtttttccaaaagtttctttcatcgcttttgcaagataattccggtgcaaatgaaactgctgctccagaatctgatttgtaatcggatgttccagattattttccagataaatctgaatctgttctgccagcagtgtcagtctgtctttatgcatccctgcattttcaattgtctttaaaaatcttaaaaataattcttctgttttccagatatcatgttcccctgccgtactgtccagtatattctgaaacaattcaaacagcaattccggctccttaatagtcgaatatttttgcagatgcagagtatacgaacactgatgataatgttgtcctgatatcggaagctttgatacaaaacggctcgccttcggtccttgtttccactgtgctgttgtataaaaatgcagccagtaaaaacccgtatcttcctgacagggtttccaggaataatggtgtctgtccggcaataagataaacatttcattttctttgacttcatactgtttctctccttccgcaagaaacagagcgcctttttttacggcaatcaaatcaaaaaagcctagattttttcgttctacgtggctttgcccctttctcataattttataatttccttctataaaatcaggaaaaggcggaatggaaatggaaatcatatcaccggacatctatttttaaaccctttcttttttcagcgtaatcttttgcaaacctttttcatttgcaagctctattatatcaccatctgaaataaaataaaatcccctgctgtatggtgcaaaacttgtgattttatattctgtatccgtttcttcaaaacttccattgataaccagaatagaagtctctttttttataatgaaagctttatctccaaagttctccagataagcaaccagctcctctcccatatcccagtcaggagtctggctgtcattatcaaataactttgcaaaaattcctccatctctataaaacgccgactgaccaaagcgttctcttgaaagatccggtcgatttatatgtggtcctgcaactgcataagtagatgctgccattcctttttctaatggagaagttgctgttgaatgagtatcataacagtaaaggattcctgccgttgcccgataacctgcctctaaatatctcgtatcttttaatttatcaaatactttataagcagaagcagccgtaactcctccccataaagaatgaatcatataggtcaaagcctcccaccagcggtctggattttgagccctaaagtcattggaatagccaatattggcaagtaaaagcgctccatattgttttgcactttcgattcgcccactttcacacagcgcaccggctgttggtccaaaaccggcattgtcaaaaaaatgttctgtgatggctgctttataagtctttgcctcctcatctattttatccatcacgctttcccagattgctttgattttattatattgttccattctaccttttttctttaatttatctagcaaacgttcaaaatacaagaaataaacacctaacatctgagattcttcttttcctcgttcctcttggtggagttctggatttacccttaattcaaatatttccgttgcccattccaagtaggtatctgcggtattgagcaccagtgtttcatcctcaaattccgataacaggtaaaacaaatgtgcaatatattcaaagtccatacaacgataaaaatctccgtatagctttctcggttttctaaaatcaccgtcgataaaccattttggacgtacataattaactgcacatttttctactttctgaacctgactggcatctaattttccaagcagatttttttgtaaaaccagatttgcttttccaagagattctccctgattggaaatcggttcaaatgcaaatggcggataaattgtctcatcatgatacaatttatcacagatatattccacacgttcttcaataaccgtttcgattttgtccattacgttaagcacaacaaaatcttcggtatcattatcaaatcgaagcacaattttatgttcgcccattgcagacggtttaaaaatcagctgatactgttctttattttttttgtctcgacagacttctacaactgttttctttctttcatcctgcactttataaaaagcatccgccgaaaccatagaaataccttccggagtttctacagatatccttgacacttccccgataatattaagcggtgtatattctacctttggatgtctccatttgagtccttctttataaaaatcttcttccccttgatttgcgctcatgacatactgccagtttttcttttctcctgcttctaagttaaaaccatctttttcataaatccagtcatgattcttaaaaccttctggataaccgccagccagatataatttatgaaataacattccatccaaagacggagaaacatcttcaaagaacaaatttaaataatcacagtaagttcctactgattttgtctgtccttttatttgataaaacccaagactttctccacttccatctctgcgcaccatgcttaatttagtataatccttagaaataaacggaaacactgccgctgaattatgaatgtttttcagcacatttttatcccgaaacatcacataagcaaacgaagtccaaattccaaattccttaatattcattcttttttgactcttattttccagctcaatgctccaaaagagtgcttcctcatcttttcctaaatcataaaactgttttactttaagagtctcaaattcatagacaacttcaatccctttctctgtttcttttaaaaccggaacactcatccgacttccaaacttctctttatctgctataagttcaaaaaaaccaaataatttatctgcgtctttataatttttttcctgtaaataactgtcctcaatcacccagttcatctgatatgggtcatctttcatggtcagatttgatacatacccctctttgtttacttccatacggaatttcttattttctatcatcatataatatttcacacctttcctaagtttaaatttatcatcctattacgcttattgctatagaaaatttcaatcaaaacttaagaaatttcacactcacgaatcattagagtaaatttaacattttttcatatacttcttcgttcttctcaattattaatgtcaatcgttcttttgcctgatttaattgatgaaaaagacttcttacttcctgttttccttcttctttacagacattcgttctaagatatcctttttcgtcataataataagcatcattcaacaccatgacaagctgttctgcttctttattctcttttatctgtcctttatttttttgatattcatagccctgtcggatataatcctttagtagattttttgtttcttttttctcatttgcatagaccacgtccacatgaggataatttcttgttccctttttatccggcagatgcaggatattttgaataaaagaagataattctgcattggtacgaatccggttggtcagatgaaagctctgaatctgtggtagattttcaatcctctccatgacactttggtccatttcatccggagaaatcatatcttctgaatcactggaaaaaattactggttgatgttcacttaactctaataaaatttctaatttttctaatgtcagaagatgtgcttcatcgactaagattccactataattttttaactgtaattcatgatttaactgcttatctgaaagaaaatcaatccgctgtaacctctcatgtaataatttccatttttcttcagactctccacaatgaaccatacagaccctctgttttttcgctgaaagtttcattgcaatatcataaagtaataacgtctttcctgtacctggaagtcctgtaaaaataaaatatcccgatttttctgcccaaacccgtttcaatatctgtcgttcaatatctctttgctgtgaagttaaaaaatattctttttccaaaaaacggactggctctgtcaaaggagaaatcaaatataattccgcctgaaataaatcttcaatctcgccctcataatctgcactattcttttgcagggcactgcataactgttcccagtctgcatccacgatatggtcatgattcgtcagctttaccagccgtttctgactgctgatgtaggtataagataaaatagattttccaaacacagacagataatacttattttgaagaagctgttttttgattgcatcttctgatacacccccgctttttaattcaatatttacaatctgttcttcttttatctgaagaaggtcaaactccttacccagctttggtatctgaaaagaataaaaaaaacgcaacgcagacacatctgacatttgcaattccaactgttttaccagttctttcatactgtctaattcccactcacgcatttttaaaaaatattttctgccagataaatgacgttctaatttttgcagacattctatcttttgatttcgggtaagcgtataaattgatattgatttcatttttactactcctgaaaaatttttcaatcttccctattttaaacttaatttgattaaaaccaggactgaataccactattctatcctactttcctttccctgtcgagtcagcttgttaagcaggtactcgcaattgaagcaggaaacttccttaattcggttaaacaaaaaaacagtcagaacaacttctttttgtcctgactgtttttctaacaatttatttgttttttattttcttgactgctctattgtgcatttatcatggcatgccacctctaattgtgaacttctctcaatgtatgaagcatcactctgcccaggttccatttacaaaaatatctgttttacttccatcctcacggattcctacaatgcgcaggtcatctgaccctaccataaagtccatgtgaatcattgaatcgttgatgcctctttcatggatttcttcctccgtcatgtccataaatccttcaatgacttctgaaaatccacgtccggctgcaacatgacagcaggcattttcatcaaataaggtattataaaacatcagacctgactgattaattggagattcttttggaacaagtgcgacttctccaagcatagaagctccttcatccatcgcaaacatttttttcagaacttcctctccctcttctgcatgacattccacaactcttccgtctttaaaatcaacggtaaaatgattaatgacctgtccagaacggctgagtggttttgtggaaaccagacgtccctcacattttcctttcattggactggtaaatacttcttctgtcggcatatttggaacaaagaatgtctgattgatatgattgacgtcgcctgcacttccccattttgcaccaggaatcagctctactgtaaaatccgttccgttactactggtataatgaagagatttaaagttctgctcattcaaccagttcgctttctttgtcatacgctcattatgtgcctgccagattttctctgcatcttccccatcttttaaataaacgcagtcaaaaattgcattccataacttgtcaactgctacgtcttctggttcattcggaaatacttttttcgcccatttttcagaagctgctgcaacaatcagccattgatgttttccgtcaatctggtcacgatatttttttaagactttctgacgcatctgatttacagttgaaattaaatccggtgaaataccggataattcatctgggtctgaagaatcaataaaaatacgaaccggcagagtttctgtcatctgttttgcacgttcttcctcccatactgcaacctctccaagtacatccgatgttgcatactgataatgcagtttattcacttcaccacaggaccagaacaactccacataacttgcaccagccttataacactcttctgtaaccatttttacaagcggaatctggtctacttcagcctgcagacgaacccgctgacctttctgtacatttgctccaatttttacaatcagcttggcatactctcttaatttgttttcattcattgtaaacaatctcccgtcatttaaattcttatactttgtgatttatttcagacatcttatttttgtcttttatcactgttaattaagagtatacctgctttttattagcttcgcaaggataggatttatctttaaaaaatatccagcatattatcaagataaattgcttctcttacatgaatctgatactccggttttgtcatataatagagcagaaattccaaaatcagtgcgcttccaagcccacgtccttctattttaaaattagaaaatcccattggcatgtagacatttctaatatcttctaatccaatgaaacctggattggttattgcctttgaaaagcgatatccctcccctgcatttggtgcactacaaggatgctctgctccattttctccaagatttttccgactaactgcttcatagcagattttcctgtccctgcatcccaaccagcaacattcattacagagaaattctactttatctttttgttcttctgaaagtgttttccatttatccaatgctttatttaaacgaaagtccggcacaacatagccaaactcttcacgattaatttcttttcttaactcttcaaattcagttaaaactttcgtagtagaagaaacaaaatacagatttgggtaatttactttcaagtagtctaataacaaatctgaatggataattatgccattttgtttttcttttcccttattaaacaatgcacacagcgcattacatcttttatccgaaagatgttcttcttttaataaagaattactaaaagtcaaccgtgctgaaattccatattcctgcataagttctaaaacttcctgtggtctgctgtctccacattccacacgaccgccaccccagaggcagtcccacggcgctccataaatggaaccaatttcacaccagtcataaaaatattctctatgtttccgaaacaggggtaaaaacaagcgataaagttcatagaattcaaacaaacccggaagatgataataggcttttcttttttttaattgtgtcatatctcattttcacctttttctatattttttattttactcattttagctaatagtactgttgaaatcggcattaccaaaacgcaggcaatcgctcctagaagcattgatgcacagctttgaaataaaattttagagttaagcaaaaattctaaggagtcatttctcatttttaaataagaaagcaataacagagattctccaaaatatgcaaacaataatgtattaatagttgttccaattacatcttttcctactcgtattccactttcaattaattctttatttgtcatatccggtttgtgacttttcacttcatataaggaagccgtaactgtaaaagccatatctatcactgcacctaatgtactaagcaaaattacagccacttgaactttttgcatactaatatctaagttcatatcgtagtaaagaacctcttcgcctgccgattgaatttcatttaagcctccagccctacttccccatattactccttgaactacaaatactaaaacagacatcgtaattaatactgcaataaaagcactccatgtttttatattcgacccattttgataaaacagtgtaatgtaagacactatagcccctattaagattattaataaaaaaacaggtaccccctctgccataagccagattcccatactcaagaaaaataaatttccacacagagcaactaaagacattccacctctgtctccgccaataataagaatagaaatcaataaaatcaatcccaatacacctaacatattcttttctttccttttacagatatctttattataatcgaagtaataacaatagagacaggtatcgcccatacaattcctatacattcaatgagaaaacggcatatttcacatgggatgtttaattttataattgtaataaggcggacatcattgttcatttgaattaagcacattggaattaattcacagacaaacacgcacattaacacatttaacatagttcccataatatcataaccaatttctcttcctgattgaaaaagctgtccaaatgttacatttgattttttctcaatgatctcacttaatgctgcggatattgcaacagccacatccataactgctcccaatccagaaaggataatttctgcgtgaaagatttcctctgtattctctatatttctcagacctaaatattccatggtcgaataatctaaatcactcctgcgaacaactacatcaaatattatcataatcattgcaattacacaaagggttgaaagcaatgccgcccatgtttttctatgtatcccatttaatccgattaatgtaactactgcaaataaaattacgatttcattacaaatttttaatatatttgaagtatctcctaatatccaaaatccaactatgaatactatgatgtttatagttactgtcataaacgtaaatattccttgtctgcctgcggttaaaatcaacattataattaatattccaagcaagcttacgattattgtatcccgttttaacccacgtacacctgttcctatgtcatctacagaaccatttaataatactttatcccctttatgataaggttgcctcaacattccagtatctgtatattcattagaaaaatgaacttcttttcctttattctttccattcaatataattccctgaattttctgtttatatcttgtctcttctgttcctcttgtacttctcacctgacctgatatgcttgtttccacctttgttaactttgcgattggagtatgatatagccatgcatcattcattacaaatagaatgctcaataagtagaaaattccaataatccaatattttttttcaaccaacttaataccaacaaacatttttattcttttaccctcatgtctgcatttgcaagtctgcaaaatgtcgtatcataatccttttctttataagtttcaaatgttccctgaacttcaatttctgtatcttctgccggatattcatctgggtatttatgcgagccatctccccagacaaactctaatccttgcgcacaacatgccctcgcatcttttataatgcaatagtgatagcatgttcctgccgaatactattctttattatttctacactcattacaaattccatagaaaacagtacgcaatgagtccatttcaaaactatgatgttccatcatatgtttttttaagctttcaacctcatcacaatgtaaatgaatcaatttcccacatttttcgcatttacaatgataagaacattctttttctactgtttgacaatttcctgtatactcaaaacatgcactgctggttccgtctacaacatactttgcgaccactccctcttttaccattttttccaaatgacgatataccgttgtcgttccaaccgatattcctttttccttaaaatagtcacaaatctcatttacagtaacatgttttccttgtacagattctaaaaatgtaagtaactcagccatttgttttgttttatatggtgcttttgacattttaactttccctccaatttggaaatcattttatcacaaaaacttcttttgtcaacataatttgaaaacaactttcattttatctaaattctatttttcttctattctaactgcttcattttttcatgtcaaacttgattttatttcacctatgtactatcattaaaaagcacaagcaccagaaaacaccaaaaaaggagactcttatttttatgcaaacaaataaagattttctaggcaccgagccaatcggaaggctccttcttaaactgtctgttccaacggtaatcgcccagctgattaacatgctttacaacattgtagaccgaatttacatcggtcatattcccaagagcggaagtctggcacttacaggagtcggtgtctgtatgccggttattatgattgtatctgcatttgcggcactggtcagctccggcggcgcaccacgcgcttctatttttatgggaaaacaggaacatgactctgccgaaaagactttaagtaactgttttatacttcagattatcatttctattattttaacgattattttacttcgctggggcaagaatctgttgctggcttttggtgccagtgaaaataccatccaatatgcagtcgactatctgcatatctatgctttcggtacactttttgtccagttgacgctcggaatgaatgcatttattacggcacagggatttacttctgtttctatgatttctgtcctgattggtgcgatctgcaacattactttagacccggtttttatttttgcttttcatatgggtgtaaaaggtgctgcacttgcaaccgttctttcacaggctgtttctactatctgggtcgtactctttctttgcggtaaaaaaacacagattcacattcgaaaggactatctgcctttaaaagcaactattattcttccctgtattgcacttggactcgctgcttttatcatgcaggcaagtgaaagtattgtagcagtttgctttaattcttcacttctccgctacggtggggatattgcagttggagctatgaccattttaaccagtgttatgcagtttgccatgcttcctttacagggaattgcacaaggtgcacagccaatttccagctataattacggtgctaaaaatgcagaacgcgtaaagaagacatttcgtattcttttaacgacctgcctgacgtattccatcgcactctggatgaccgtacaactgattccaaaagtatttgtaggtattttcacctccgacgcagaccttgtcaactttactgcgcctatgctgaaaatttatcttggcggtctgtttttatttggaattcagattgcctgccagatgacttttacttctcttggtaaagctgtaaattctattatcgttgcggttgttcgaaaatttgtattactaattccgctgatttacctgattccgcaccttgtatccaatccagttatcggtgtttatatggcagaaccgatcgcagatatcattgcggtactctttacttctgcgctgttttcttttcagtttaaaaaaacaattgcagaaattcaaaactgaattttaatgaaaggaacttaccatgaatacactaaagaaattcattcactactatggtccgtataaaacggtcttttttattgaccttctctgtgcaactatcattagtcttgtggatctctcttatccacagattcttcggactgcaacaaaaacactcttcacgcagaataaaagcatcattcttcatgcccttccatggcttggcatcggattacttttaatgtacataattcaaagtttttgcaaatattatgtcagctatcagggacacatgatgggagctaacatggaacgggatatgcgtcaacaactctttgaccattacgaagaattatctttttcttattacagtcaaaataattccggtcagatgatgagtaaactggtcagtgacctgttcgacatctctgaatttgcacaccatggacctgaaaatctttttatttcactagtcaaaattatcggagcttttatttttctcttttttattaataaaaaacttgctctgcctttgattctgcttgtaattgtgatgtttctcttctcttttcatcagaatcataaaatgcagcaaacctttatggaaaacagaagaaaaatcggtgatgtgaatgcaagcctgcaggatactttatccggaatccgagtggtacagtctttcacaaatgaagagattgaaaaagaaaaattcagaaaaagcaatcacgcctttcttgtttccaaagacaataactacaagtgcatgggggaatttatgagttccaatctgttcttccagggcatgatgtaccttatcaccttaatctatggaggttatctgattgccaatcatgaaatgtatcctgctgaccttgccatgtatgccctgtatatcggaattttcatcagtccaatccagatcttggtagaattgatggaaatgatgcaaaaaggattctctggtttccgccgttttcttgacgtcatggaaactgttccggaaattcaggataaaccagacgcagtagaacttacaaatgtaaagggacatgtctgctataaagatgtgacgttccactataacgatgatgaagcaaccgtactttctcatgtgtctattgatatccctgccggaaaatctgtcgcactggtcggtccctctggcgcaggaaaaacaactatctgttctctgcttccccgtttttatgatgtaacaggtggtcaaatcacagttgatggacaagatgtccgctctcttaccttaaagagtctgcgaagtcagattggtgttgttcagcaggatgtttatctgttctccggaaccattcgtgaaaatattgcttacggaaaaccagatgcatcagaagaagaaatcattacggctgcaaaatgcgccaatattcatgaatttatcatggaactgccagaacagtatgatacctttgtcggcgaacgtggtgcaaggctttccggtggtcagaaacagcgcatctctattgcacgtgtattcttaaagaatcctccaattctgattcttgatgaggctacgagtgctttggataatgaaagtgaacgctggattcagcgcagtctcgaagaactctcgaaagatcgcacgaccattactattgcccaccgcttgtctactatcaaaaatgcagacgaaattattgttctcacagaaaatggaattgcagaacgtggaacacatgaaagtctgcttgagaaaaacggaatttatgctggttattacaatctttctaactaatcaaaattagatcagatttccggctatattcaaaaaatccgagagccattctatcactttagctctcggattttattttttctctctataatagacaagcggatattcgcaattgaagcaggggacttacttgatttggttaaactaccgcatttcttttttctgaaaaaactacggtcaacttgtcaatcactttattacaaagcactgtataaagtgcgccaaatacatttgctccaatacgaagtgctactgccattggcataccaaataaacctgatgcaattgacaatgctccaaatgtattaaatacggtctgccatgcatatcctgccgaatatcctactccgattccgccaatcatgccaatatagggatacatggattctggaagaatcagatacagcacaataaaaaatacgcacccaacgatattaaactgccatctttttcctgatctggcaacacagtcttctgtaaaaggaaggcatacagacatgcaggcaatccctgcccacattgctcttggcaatcctaaaagattcatacccagcattgcagtagaaacaatcaaagtcagcttcagataccatctgcctcttgctgactgtaagtcaaattctcgaaaaagatccagaaacgttcttcgatacggacgattcttctggtttttataaaagataaccatacaaagaatcattcccactgcaagtccctctactctttttatgtattctgctcctgtcacatcatatccaagcaacagcagatatcctaatacaaaagtagaatgattgtacataattacattgtggcaacctaaaatcatcagaagaagaattgcaattacatttactaaaaaagccggcaatggagacaacatattggcaatccttggtgctaccatcaaaagcccaaaaattcctgcgattgaaaacagcccatgcgtcgttttaatcccaaaatctgcttgtcgaagaacaagaaccgccaacaataccgtaacacctacgacactgttttcactcccaattagtttactgtacaaagataccactgcaacacaaaatgccataaccaaataaactttaaaattataaatcagaatatgcctgcgtctctcttttggatctttcgtgtttttgattaattgttttgagcctgttgaacttaactgaagctcttgataaaatgtcataattttcgctccttttttctcaaagtgtagagaactataccgcaaatacgacctgttgtcaagaacaaattaaacccaaatcatgctcttttcaccactgtgaactactcggcaactaagttaccagagtatctgaaatctgacgggataccgcatttctctcggaatcataacaggtcatcagactatgaagtcccggatcaatcgataaaatatttactgatttcttgtatcttacctctctattttcctttcatgtataaacctgctttcaacgccaaaaacagaaatcgaacaccatcattttcttttccgtaaatttcaggaatatcatccacttttggattgattttataaaaagtattacttttatctgcacctgttctctcctcaatcaaccttctcattttactgataggcgtaatactctccagctcttcctctgaaaaacccagtgcaagtccaagatttgcatctggatccacatctacagcaaatacttttttcccttcttatgcatacagacgtgctattactgcagatatcgtagttttccctactccgccttttccagttacagcaattttcatctgttacctccttaaatgcttcttactccacttcctccagttctgttccttctgaaagaatatatccgcagttatcacatactccgtcctctgcaagtatcccgtctttcacaaaggcttcaatgcctcccggttcatgacagcgtggacaatctaattcctgtatctttttctgatttcttacatcctgacaattggcaaattcgattttacccatagtgattcctccattttcattccatatcaatttgtcttcgcaaaaaagttcctaccatacgagaaaaattgctgatattacgaatataggcaaagtcttttccatagattctcttttccacggagagttcttcttcattccctacaaaaataccaattacgaaaatcccctgatttctggcccgacgcacctcatatgcagtatctttcacagctccttctccgtcatagagcttgggctggcgggttcctggtcgttgtatgctcatatcgcaaggttttccatcacttaatacgattaaaatcttatttttttccggtcgctccataagagaggaacagactgttttcagtgcaagcccatctctgttattagcataggcccgaaattgaaagattctttcatttgtttcccttggatcttcataatcccgaaatctctgaagtactgtatatccccagaaagcacagtatcctgtcacccgatgaggaattcctgcctggcttaatgcttcactgataatatatccctgtgccgctacctgagcctgtctgccagcttgggaaccactggaatcaatcaggacgtctattgcaaactcagaatcttctgatctcttttttctattaaataacttgtcatcgtctgttcttccaattttccataacctctcaggaacaagctgccctgcatcagatctgctgacaaaatcatcctttcggattataaacgcccgtttcagtgactctgctaacacagaaatatttcttttgataatccagtgattatttccataataggctttatttttttcaaactgcagctgagaaaaacggtattgattattttttatcacagggttctgtaaaattccatctgtaagatacaggatacagtttttgtggattcctgtacaaaatttccggttgactctggcctgctccgattcacttagatacgattttccgtaattcagttccacatattcccgtatccgtcgcactgactgtggatttatattctccgagctttccggaacttcttcattttccggagagaaataaaatctttttttctttttgtttctgatatccagactcatcatcttttttttgagattagaaagatatttttgaatgatgtcttccatctgttcatccgtcatacattcctgccacgcgtcattggccaatgccatatccggtaaattcagaatcttctccagatttccattccttttttcaaaagagggatccagaacatgattataaatctcctctataacgtttatgacatcttccgtattttccgcatccttcagagaaagaattttgtacaatgcaatctctgcctgtggatccgttccctcatcgtttgtgttctccagaacatgctttatatacagaagtctaatcctgtgaatcaggtctgttccagctttgtttgatacctgttctttctcggccttttccaattctctgaacgcctgttctctgattttctttgttcccaaacgttctcgaatgataaaacgattcactgcagcatccatgcataatccagcaagaggcaaaagcatatcttctccagcagaaaaatgtaattttttcatcaaatacatgccaagtttcttctgatcaaaatatcgtgcaaaggccccctgctttactgcctcatataaaaccgtttgttttgaataaacatatttttctgtgtccggttcaaattctatatcataatcaccactgactgtccaaaaaagatttctgatacgattactaatctccagacgatgttcttccagttgttctgccgaccatctgacatcctccatacaaatttacccccatatgtcttttccggtccaggaagatggaattctggtagaaaccacatcttctacgatctctttttcaaatacatcaaaacttttatttatgatccccatctggattgcatcaattggagaaagtccgcttcttgttgcttttacagcagaaaccaatcctctcaggtcaagagattttgttgagatttctccatgataagccttgatctgcaaatccagaaacagtcctgcaaaagctttcagtgcgcttttttccccatctggaaaatgctgtcttaatacaaaaaggacactatcctcatccatttcaggcatatcaattaccataaaccttgaaaccaatgcttcatttaactctctggtacctgcgtaaccataattcatcgtaccgataaatcgtgttgccggatgaagtaaaatcctgttatatcctggaatatcgattctgcgccgatgatccaatgtggcatgcagtacagaaacggcatcattttttgccatattgatttcgtccaggattccaaatcctccaaattccgcacattggtagatggggcctttccgaaggcaaacctcattatttataaaggtatccgttccaatcagatcggcactgtctgtatttacatgaaaagaaatgtcgtattccggtcttccgaatatccatgccagtgtctcacatagtacatttttccctgtagctttcgcaccggaaagtaacaggttatctccctgaagaagcgctactattgacatttccagaatctttttcccataaaataggatatccggtttttctacccgttcctttacctgctcctctacctcataacgcatgtgaaaatctctcagctctccaatcaattcctgcgctatcttctggtcttctaaatatttttctatttctgtccaatgatttctcatgaagattttcctttctttgcaattggttataccaaatcagataatatttctgtttactcaaaattgtatccagtaagcagcgctgattctgtactttttccacagccacctttgccacatactgtaatcttcataccttcaatcctccaactcacagtcctagcttctttacaatttctcccagtgcacttcttacaggagaatctttcggaagccgtatgatcggctttccatcacagtcatactgatatacctggtcatcatgtggtacaacccctaacagttccagtccctgatttcggatttcttccagagttccggcatccagttttccatctggaacacgattcacgatcaatcctgttttctgtggtttaaaattcaattccttcatcagctttgcaatacgtccggctgcctgaacacctcttctggaacagtcactcacaagaatcgcaacttccatcattggcaggatgcctctgctgatgtgttccatacctgcttcgttatcaaccacaatatatggataatggctttgcagtttctgaacctgggtctgtacaagaccatttacaaaacaataacagccctgtccctgggttctccccattaccatcaaatcataatcatcttcttctgcaattgcatcggaaagacgcatttccagatatgcctgttttgtcataccggacgggatctgatatcgtgggtcgacacctgcccgctcaatttcttctctcaattctccaagtttgatttccggctccacaccaagtacttcatttagattggcattcgcatctgcatctacggccagaaccggacgtttcccactttcgcacaaatactggatcaataatccacaaagggtagtttttcctacgccgccttttcctgatactgcaattacatgtcccatatttttcctcctaaaattctaaacaatctgttgactttttctttaaaccccattatagttgttactatataaattacaataaccaatctatgaaatctgttctgttcctcaacatatcccaaaaactgttgagaaatgatacattgtaaagcatacattcaatggaggtcattatgtcggaaaaaacaaaaaagcaggatcgccgtaccagatataccaaacaagctataaaagaaacttttttagaattattaaagcagaaaaatttcacaaaaatcacggtcactgaaatctgtaaaatttctgaaataaacagaggtactttttatctgcattattacgatatccatgacgtgttggaagatattttaaatgatatcgcacaggatatgaaaacaactgtagaacatttattttgcccaaaccaaaaaagctgttcctatcccttctgccaaaagattcaaacagaaacaaaatacagatctctgtttctggatgatacgattgctcccattcttctggaaaaaatagcagaaaatacaaaagaaggctatgtgacctggcttatgtcacacagccttctgacctttgagcaggcagaatcggttttttattttcaaatgaatggctgcctttctatcaacagactgatgctccgcaatcactgtaatgactggcaacagattcagacaacaattgacaaatttatcaaagccggactggaaagttttctgattcatgatcagaggcaagaaaatgcttccgataatttttgcagcaaaacttccccaactgttactgcatcttctacactcagataatgatccgcatgatcctgaagaaatattttgccagatacaggaaattcttcatctgcaaaccatacctttaaagttactgaatatcttggaaaaactggaaaaacagcacataaatccgcctttgtctctataaattctgcacccagacttgtacatgctttctgaattttctcaggatctttatcctgcaaaagcttttccagtttctgctctgcagttcggtcaaacctggttccccgaatcaatccatctttcaggttaccaaaagtaatgagcttctgtgagccttctgtgccatcggccatatccagataatgcagcaatatcagataatgccattcatccatatctgagttaatatggaatccaggaagttgaatttcaatcgtttcataaaaactcagtatctcaattgtatttcggctgctatgaaaaacagccccgctttttgcagcaatctcctctcctgaacgattttgtaaccgttttactgctacctgaaacatttcctgaaatgcacgattttctgtttgatttttgtattccataaattctcctttgtaaatattttatcgcatcatataataatcaatgtttatctactatagagcagataaatttccttttaacttgtctacaatcaacatattatacaatcctccataagtttcattcctgtgttgacttttcctttaaatttcattatagttgtaattatattatttacaataacccaaataaaaaaaggagtttcttatcatgaaatattcaacgaaattaagcgatactgttcatgtgatggttctgattgctatcaaccaggaaaaatctctctccagtacctcaattgcagaaagtgtccatacaaatcccggctttgtacgccagcttatgttaaaactaaaaaaagccggacttatgaccagtgtagccggacatgctcgtccttctctttcaaaaccagcagaccagattacattgctggatatttataaagcagttgaaggtgagaagccgctgcttcatttagatactcataccaaccctgattgcggcgttggcattaatattcagttgtctttgcagggattctataatgaaatccaaaaaactgctgaagaaaaaatgaatacaattactttacaggatatcataaatacctattatcagcgaacatccatgcacaatgatttacaaaacattatatgacaagagaatattcttatgtaccttcagcagatacgaaataccaccatttttttatgttatggtggcaaaagatttttaattgatcctgtattagtaccaaaaggaagctgacctccttttcctaattcgattcgtcaggttcaaaacaatccactggtggatcttccctttcccattaattaacgtttaaaagccgatgcatatattattacacatctgcatacagatcactttgatgaatgggcacaacaaatcaaaaactatcccttaccagattttccactttgcgatattcacttttttcttctaaacggattactatattatttttcatgatcggattcagtaagcaggtccagccacgagatactgctgatataacttctgcatctctttactgcgaaattgctctattgtcagcatcttccgaaacgatgacgcaatatcatcctatgtccagtattcaaatacattgtttaatattccttttctatctcgctatctattccatacattttcttgaacgcatcaaggtctgcctggttcttaatcagtataacctcttctatcttacctgtatgaatgtctttaaacccaactacttgctcgccattacatatgctcgctttgattactggtttcttattttctttatcatatgtctttgtaactgcctttttcttaaatagacccactctaagcaccttcttttgactttgccatcagtataagtttttcaaaggactgtgcaaagcatacaccatcttcttctgtacgctttcccggttctttcatctatattcttatgagcgttgtttcacatatttgatttgcctgtgttccattcttctcatctgaatcgacatttccatttctgccaagaacatgatcaaactcatcaagaatatccagcattaagccttcatcaatccgacttctacactctgcagcaatactgcctgaattccataagatcatacaagcctttgggagcaatctccactttttactttccatttatcactgttcaatgacctgcatttcggtaccccccccccgccggattttatgcttctgatcgtcttttccaataccttcatctcaaccggttttgaaacatgggcattcataccggctgccagagaatgctgaatatcctcagaaaacgcattggcggtcatagcaatgatcggaattgtcattgccagttcatgagaacttctgcggattgcttttgttgcctcataaccgttcatgacaggcatctgcacatccatcaggatcatgtcataatcccccggggcagactgttcaaatgtctccagaactctttcaccattttcacagatgatgcactctgcaccctcaatttttaacagttccatcaaaatctctgcattcagctcattatcctccgcacacaggaatctcattccctgaaggatattatcatcctgttcatctatttcttcttgtgctgccaaagcaattgttctctcctctgcaattctcatatctatgagaacctcaaaacagcttccttgtcccagtttactctccaaatcaatggtgcctcccattgctttaaccagatttctggtaatagccattccgagaccggttccctgtatcttattagtcatagaactttcagcgcgggtaaacggatcaaaaatcgtctctttgaaatctgcagacattcccataccattatcgctgactaagaaacggtactttgcatagacagatgactttgtctcacattcttctaccagaaactgaatttttccaccttcctgcgtgtacttcactgcattagaaagcaagttgctgaaaatctgcatcagatgaacctgatctccgttcacccattcatgccggatgttttcttttatgatcgtaagagtctgttttttttcatctatctgtgactgaaataaagtattgatttcctgtataaaattcagaatggaaaaatcattgtatttaaaaactgtttttcctgcttcaatcttactcatatccagaacatcattaataatccctaacagatgctgtgatgaaatatctattttatctgcatactctattactttatctttattccctgcatcatatctgattaatgatgtcataccaataattgcattcattggtgtacgaatatcatgtgacatattggacaggaaatctgttttcgccttatttgcattttcagcggtctgcaaggcttccgttgtaatgtcctttgcttttttcagttttttattggactcctccatttccttcattgcctgcgtctgaatctcattatttcttttttcatattcagctttttgctcagcaagactgcgtctagaaatactgtagaataatccggcaaaaagcaaaagtataaaacctgccatgagtattgtttcaaacactattgttttctgataatctttcagtacattatctacaacactcttttctacaatacagatcagcatggtgttattattttctatcggacagtatcccagatagtaaggtttgtcacttcccagaagttctaccccctgttctctgccatccagctttttttgaagagaatcagcctcttcctcagtgatagcctgatctccttttaaatgctttaacaaaaaatagttcctaaaaaatttatcttctatctgatttgtataagtaatatttccgtcgttatccagcataaacagatacgcattcccgttatagcttttcacacttaacatggaatctaattttgaatgatcatacaaggttccaattgccgtataagtttccccattaatcgtatattcctgacatggaattgcaaccagataaccatcttttttcttctggttataatcaagagaaaccaattttccaatattatatccgttcctcaaatccaacaaacatttacttggcatgtcaacccgaagttttgttccatcagtggttattgcctttccattttcctggagaaatagaagtgtactttcagattctttctgccatgcctcaaagaacttcttgtttctatccagttcaatagatctcacttcctcttgaataagagaatcctcaagcaaatgcagctggctgtagtatccattcacctgcagatcataggtctgctgtatctgttcaacaacagctcccatactgcttttcccgttttccgtgatatagctgttcatcctgttcaaaaggaactttacaaaaattaagcttaaaaagataagaattaaaaagaacaatggcattataatcttttttctttttgttattacttgttctattcccacttttatttttcaacctctatataatcttccggtactgacggctgctgtccgtttgccattgctacggtccatgcacttgataatgttgtgttcccaagctgcctgatctcacattccagatttatttttttcaaaacagacattgtggtttctgtaagaagaatagagtactccttgtctttgtctatttttttcttatttacttctatgtcctttaatgagaatccgttttcctcctgcctgacgattattttcataccggatgcaattggcaattcgtatttattggttatgtgaaatttctcatcggactcagcaagatatttctccgcaagttcataaatttctttgccattgatttttgccaggtataaaaatgtatctgaactctttgccgtcatcaaagcaactcggctgccggtgcactctcctttgtaaatggaagaagtaaaataataatatggcaccagagccagctgcgcatcattttcttctctgatcgtagttaaaatagaagatgccgcatcgcgaccgtttttatcatttagcgaaatggcatattcgttttcaaaattaactgtggtttcttcttttgaatccttgctgttcattgtgctgcgaaaagtatcataagcctgtgtttcatccatttcccctgacaataatccgtgaacagccttaaggctggcatcaaatgatttttgagcagaatatcggatataaacagaattattattaatttcatcttcaaggccaggtacatcttccatcatgtttggaacatctacatttaatgaaattacaccctttccatctgcgatcagcgtttgtccttcttttgaaatcatacactccaggacatcgaatgccagatccagtttttcctgatctttttccaggtctttgttgaatgcaatattcagagaaggggtcatatttataaaagcttcatccgaaatctgtgaaaaaaacggtatacgagttaattctgcatccatctgttcctgatattcctgcataagtgccggataaccatgaaacattgctgcttttccctcaaggaacatctgcgctgcagtattaagatcgacgctgatatcatcacttgtaaaatgtgagtctttcaaaaatgtattggtttctgaaaaaatacgtttccataacgcatcatcaaacgcgatatcccctgatgcactttcagctgaacttctccattcgattccatccagactcatgaattcaccgattgcacctgtctgaatcacctcatgagtggaccagtcttctgcaagatccagggaatacggttttataccattatcataaaattgctggcatgcctgtgcatattccttatagtttttcggtatcttgattccatactgttcaaacaatgtcttgttggcaataatcgtctgcggtataccgcagataggaagccactgaatctcattttttgaatttttataatattgcaatgcataggagtaatacctggaaaccacatcataagaagcaaaatccattagatatggctccagatcctgtgcatcttttccagaaaatcgacgtacggttatgatatccggcagttcaccatgttcctcaaaatagctatataaatcggtatcattgttaccggtaataaactcaatatcctgatctggaaacttctcatggatatagggtacaatatttttcattaaacgattttcccacagatacacggtaaggtgatcgtcatttttagatactgcttttttagattgtccacagccagacaaaacagtagctactacaagcacccctgacaataaagctatcagataatgttttgcctttttcatactcttattttcctcattctttcctgataaaaaccataattcaataatcccatctcagactttcatcttatttgccgattattctattataacttgtaaagcggatgtttgcaatccgcttcgctacttgctcatgcaaaaatattaatgctattatacctctctctactttttcagaagcttttcccatgcatctggaaggcaattacagccagttttccagaacatcattcaacttattcatatccagcggtttcgcgatatgtccattcatgcctgtatttttggcaagctgtacgtcttctgcaaaagcattggcagtcatggcaacaataggcagttttcccttttcacccggaaggctcctgattgccgctgttgcctcataaccattcataacaggcatttggatatccataaaaataagatcatacgaacctttcggagaagcctccactttctcaactgcaattttcccattttctgccgtttccacttttgcacctgtcatctgcaagatttcaccagcaatttctctgttcaactcattatcctcaaccagcagaatcctttttcccgtgtagtctgattctgacagcttctccaaataatttcttgcgccacagaaatacgttcatcacaagaaaaaatgagcagaaaatcccatccgactcgtcgagggcactgaaaaactgtttttacatacaatatatagtagtgtaaaacatataagtatgctttaccttgtaccgttttgtgtaaaataaggactttttcagtggtgtcgactcgtcggatggggttttctgctctataatagataaaagtatacagagatgtattatttaataggaacaaaatggaatgtaaaaaaatattttttgcttcactaatgctctgtataccaaaaagaaactgtctcactaagcaattagcagacagtttctttttttattggtaatgtatatgtgtagctgatactgcgattttcacattttttgcgtaaacttcgctgaagcagcttacgctttcttttacgcaagtttatacgcaaatttgacacaaaatcacataatactttacggtaaaatatgataagttatgatacttacgcttttttcaaaaactacagtacagagttcacaacacctgattttatagggttttcagtcttttttcaaaaaagttcgctgatgtacttagtttcccatctgttttgcaacttcttctgcaaagttttcttctttcttttcgataccttctccagtttcgaaacgaacgaatcctttcacagcaattttagcgccgttttctttagcaacctgttctacgtatttagctacagactgttttccatcttctgcttttacgtatacctgatctaacagacagatttctttcatttcttttttgatacgtccggcaatcattccctggattactttttctggtttctgagattctttcgggtcattctgaatctgagccataaggatttctttttcatgagcgatgaaatctgcacttacttcgctttcatctgtgtattttggatttaaagctgcaatctgcattgctacgtttttagccatttctttaacagcgtcgtttacaacatctgtttcaacatcaacaagaacgccgatttttccgcccatgtgtgtgtaagaagctacaaatccgtttgcttcttcaactttagcgaatcttctgatgttcatgttttcaccgattactgcaatctgagctgctaaagcttcgtttacagtcttagttgtatcaaatttccatgtttcagcaaggaacgcttctacgtcagcagcttctgtttccataacctgttctgcaacctgtgcaacatatccctggaatttgtcgtttttagcaacgaagtctgtttctgcattaacttctacaacaactgctttctttccatcttctgatacgagagttttgcaaagaccttcagctgcaacacggctagcttttttctgagcagtagcaagacctttttctcttaaaaattctactgctttatccatatcgccttctgtagctgtaagagctttcttacaatccatcataccagcgcctgtcatttctcttaattcttttaccattcctgctgtaatagccatcgtgatagtcctcctgaatttataattattttaaaatttttccgttttattctttattaagaaaccgccctggttaaaaagccagggcgttatgaatcattgcccataaagatggggaaattattcttctactgtttcttctgcttcttcaacgaattctacatcttctgctgttccctggtttgcttcgattacagcgtctgccattttagaaacaatcagttttacggctctaattgcatcatcgttacctggaattacataatccagttcttctgggtcacagtttgtatctgcgataccgataagcggaatacccagtgtatgagcttcctgaacacagattctttcttttttcgggtctacgataaagatagcatctggaagttttttcatttctttgataccgccaaggtttttctgtaacttagccatttcttttttcagttcgattacttcttttttcggaagtacatcaaatgttccatcagcttccatagcttcgatttcttttaattttgcaattctgctctggattgttttgaagtttgtgagcataccacctaaccatctttcgtttacgtagtacattccgcaacgttcagcttctgttttgatagcatcctgagcctgttttttagttcctacgaagaggattgtgccgccttcagcagcgatatcagcaactgctttataagcatcgtcaaccattcctacagatttctgcaggtcgatgatatagataccatttctttctgtgtagatgtatggagccattttagggttccatcttctggtctgatgtccgaaatgaacacctgcttccagtaactgtttcattgaaataacgctcattttcttatctcctttggttgttttcttccgcttatttctactcttttggaacttttttatataaaaaagcaccttccatcagaattcataagcgtggttatttttttgcaacactggcattatatcatagataaatatcgtaatcaagccatttttttgtttttttcgcacattctgtgcagccagcttttcaaaagaggcatccagctttgacactctttctgaattccacttccatctgctcttcgtaatgtttcatccgcaagcgagagtccatgctccccttctggatacagatgatattctaccggaacttttgcttttcccattgcttcaacaaaaaacatggaattttgaaacggaactgttttatcctcaaacgtatgccataaaaaagcgggcggaacttgttctcctacctgagtttccagcgccatctcttctttcttttcctcgtaagtatcccccaacagattatgtatactctccaagtgggtatactcttcttttgacgtaatcaccggatagcataaaattaatcctgacacttttagctcttctgtcttgacccctgttttctctgccacaaacggacgattccagaatactccataacttgccgcaagatgtccacccgctgaaaatcccatcacaaacactttttccgtgtcaatatgccactcttctgccttttcttttaaaagtttgattgattcagctacttctaacaatgctgttggaaaaattgccggtgcgcaggaataacgtagcacagcagcatggtatccagcactgtttaaatgcagcgcaatcatttctgcttctctgtctgctgtaaaccgataagctcctcccgggcagattaaaaccagcggtcgctttaaattcggttctaattcttcataagaatctaaaatataagtcgtcaaatgagaatcttttaaagaaccttctgcctttatggaaatatttttatgtatcataattctgtcctctttctctgttttatgtactctcggaatcattctctgtgcaaatgctgaaaattccttaagaatccttttttcttgttattctttctcaataatcgtaccacttcgatacgctgccaataatgctttcaattcttcaatattttcttttaatttccgaccattgtctgtatcttccaccgtttttcgtatcatggaacgctttaccaaaatactgtccgataaaatgtctgtctctctggtaattgcatcttctgctgacgtaaatggttcatgtgcagccagaatcattccccaggaattataaatcagcgtataacctgcaattccagtttctttttgatatgctttggaaaagcctccatcaataacaagcacttttccattacatttgattgggctttcgcctgctgcatgatgcaccggtacatgtccatttacaatatgcgcacagccttcttctaacccaaactcccgcataattcgattgattaccgtttcatcttctaacaatctgtaatatggatttttcttttcttcatgagtttctttttccgcaagaaaataccgttcaaaagttgccatcttctgtttgccaaaaagtggagaaccaggactactccagataaaccacaaaatatcttttcctttttctctctcattctcatcaattgcaacaaatgcttttctgacataagcctctaatacttcataaagtgcttttcccttgtattttttcccataaatgtctactgctttaaagcttccgtcctcatttaacggaatgcatccgtgatacagcagattattattataaaccttataaaggcttcccttctttaaaagtagattcatatggcgctgtaatttttcacagtttgtaaatgcagaagtcaatcgttccacaaccaacgtttcttcacttgacaattcatacggattatccgggtcaattgtagggaaattagagtccagtaatttatactcttttccatccaaccgaatggttccatttgcataatcaatactgtcaagcaatgcacgattcgccatatgaaattcttttcttctcatcaaaagctgtccctcaagcttaaattgaataaccgaaatggctttatgcatcttcatctgcagagaaatctctgccgggtttaaatcatttccgcctttaattttaaaacaactgcaagggtcatctttataatgaatcagagaaaatgtcgcaagcggaagcagattaattccatatccgtcttccaaaatatcaagatttgcatatcttgcacagattcggattacatttgcaatacaggttgtctgtccggctgctgctcccatccatacaatgtcatgatttccccactgaatatcaagcgaatggtaccgctcaagtttgttcataatttcatgcggtcccggtcctctgtcataaatatcaccaagaatgtgcatgtggtctacaaccagacgctgaatcacttctgaaagtgcaataataaaaacttccgctcttcctattgtaataattgtctctataatctgctcataataagcctctttatccgttagatctgatttttccgtaatcagttcctcaatcacataagcaaagtcaggtggtaacgcttttcgtacttttgaccgcgtatatttcgatgcggcctccttacagacttcaatcaaacgatacaatgtaattttataccagtccataatatcttcttcggtctttttgattaattccattttttcttttggataataaatcaaagtagcaagggagcgcttgtcctgttcatttaatgtatgcccgaacacgtcattaatttttcttcgtaccgaacccgaaccattttttaatacatgcgaaaatgcctcatactccccatgtatatcggtaagaaaatgttccgttccttttgggagatttaaaatcgcctgcagattaataatctccgtggatgcctttgcaattgtcgggtaaagctgtgacagtctttccagatactttaattccaacttttccataaatccctcctgatttttgtctttttcaccatgttttcattgtaacatactttcttttttatgaaaaccgccgaaatcaaaaaagatatccgaatcatcgttataaaacgactcggatatctcttttattacattctttccggtgcttcaaaaccaagtaaatcaatacaggtttctaatacatcacggcataatactaacagacgaatccaggatttcttctgttcttcattagattcgctaagaattttagtttcatgataaaagctgttaaatgcatttgccaaatcataaatataagaacaaatcttatgtggtgctttctcttcaaatgccggtgcaatgacagagttaaatttactaagttctaacatcagattcttttcactgtcatttactgcttctaagattgttccttcgttcggatttttgccttcctgcatatatttttccaaaatagatttaattcttacgattgtatacaagatatatggaccggtatttccttcaaaagaagtaaatctctctacatcaaagatataatctttagatgcctgattggataaatctccgtatttaattgctgcaagtcctaccatctcagcagttttttgcgcattttcatctttcacactgcggttttctacgatttttttatacatttcatcgttaatttctgcaatcagacgttccagacgcatgactccgccttctcttgtcttaaatggttttccgtcctttccgttcatcgtaccaaatccaacaaacgaaagagctgttttttcttctaccatttttgctttctttgcacaacggaatacctgtacaaaatgaagttcctgacgtttatctacaacataaataatttcatccggatgataatcttcttcacgctgtacgatggttgcaaggtccgttgtattgtaaagggaagctccgtctgattttaaaatcatacatggaggaatttcttttgtatcactctcttcttttacatctaccactaaagcgccctggtctacataagcataattatttttctttaagtagtctaccatatccggaatatatctgtctgcatcggattcacccatccataagtcaaaatccacatgcagtttggaataatttttcttcaagtcttctacggacactttcataatatggttccataatgcacggtatccgcgttttccctgctgaagctgtaatgttgcctctaacgcttcatttttgtatgcttcgtcttcttttgattttgcactggctgccggataaatctcttctaattcacttactgtaaacggtgcttcttctggatagtctccttcaaagctgtcatcaaaataaaccaattccggagaacgcttcttaagttctgtgatgatcaatcccatctgaagtccccagtctcctaaatgaacatctccgattactttatgacctaaaaaacgacccattctcttaatactctcaccgataattgcggaacgaagatgtccaacatgcagaggttttgctacatttggtccgccataatcgataataatcgtctttggtgctttttctttttcaatagataaattttcatctgcctgcatttcatttaagaactttgttaaaaatgccgacgcaatctttaaattgataaatccaggattgactgcttctgccatagaaaacagttcattctcttttaaaaatgcaaccacatcatttgcaatcataatcggcgcttttttataagtttttgcagctgccatcgctccattacactgatactcacataagtctggacgattggaaacatttactcttgcaaacttttcctcataacctgctttggtaaatgcttcttttactgcatcttccattaattccattattcttttcatcgttttttactccacttctaccttttttgagactgctactgcaagcgcaccctgtccgatatggcaggcaacacttaaagaaagcgggtccatgtgtatttccattcccggaaattctttttccagttcttttttccattcttctgcttcttccagatttcctgtataagcggcttccagacacatcagaccttttttattatattctttaaagcgttttttgaggtcttcctccatcgcttttatcataattttcttcgcctgttttttccctcttgctttcgcaaatgcatccagtttttcaccttgaatctgaagcaccggttttaattttaataccgttccaagtgcagcagcggccggtgtaattcttccacccttttttaaatattttaaagtctcaagtgtaatatagatactggattctgatttttctgcctccaggatttcttttacttgcgctcctgtctttcctgcctgaattaacgtcaaggcatctaaaacggactggcgctgtgttactgagattctttgattatctactacatgaacacgaccattaaattcgcgtgacagcacaaatgcagtctgacaggaattactcaaaccactggacattggaatatgtaccacttcctcatggtctgcaagcaatttttcccaagtttccattacatctgccggtgacggctgtgatgttgaaatatttgcatcttcttccagctttttataaaactcttcctgtgtcagggtaatcccctccaagaataactgttcattaatataaaacggcataggaagaacagtgacacctaattccttggcctgttgctgggtaataccgctgttgctatcggttacaactgcgatttttgtattttccattttttctaaactcctttgccaaataaggttacttctttttatgatagcatagactttgcttaaatacaatgcggatttttaaaaaaccggttgactgcatcctcagccagccggattttttatcaaattaactctaatcactcaaatttaattcattcttcttagtgcttcaattggacttaaatttgccgctttaattgacggaagcagtccaaatatcagtccgattgccatagaaaacaatacggatattaaaactgccggcacactgataacaagaggggtctgtgaaatcgtggaaatgatttttgccagaatcattcctgcaaacactcctaaaattcccccaatactcgtcaataccgccgcttctgtcaaaaactgtgctaaaattctccgcttatttgcaccgattgcttttttcagcccaatctcacccgttctttctgtcacagacaccagcataatattcataacgccaatgcctcctaccaaaagtgaaatgcttgcaatccagattaactgtcggtttgtattttcgctaatttgctgtaatccttttgccttttccataatatcttctgctttataggaaaccgaagtttcggtattttgaatctgctcatttaagatctgctgaacagcttttcctgcctgactcatatcttccggtgtttttgtctgaatgaccgcctgctgaggttcatcgtattgatataccactggccagacactgtctgtaatcattacaattccactttcatcattgtaataagtataatattcctcaatgctgttaatgaccggctcatattcatctgttttctttacaactccgacaacaacaaacggctcacctttaatttctatcgtcttccccagttcttcccctttttcaaaaaaactatttgctgctgtttcatcaagcagagctactttcttgaagttcgcatactctttttgattaaaacctctgcctcgaactaactgatacccacaggtatccagataatccgaatcaattccaagcacttttccgccgtccatgcttttatcttgataataaatgccatccgcataatctctcattctataaaagctggcactaactacttccggaatttctaaaatttcctctttctggctctcatttagtaccggcacaccttgtggaagtccttcatactcaatctgataatcacttcccccttcttttaacttaatttcaactacattgtctccatcaccgattaaattctttttaatctgctcattcgtccctttaattgtggagacaattgaaataattgaagcaattccgataataataccaagcatggtcagaaaggaacgcatcttatgtgcccagattccctgaaaagctaaacgtatattttcaatcatcccaaacctccatacatgttatatgcatcttctgctgaagtttcttttacagatgccccctcttttacttttttgccataaggaaaggcgataaaatcttcctctgtaatccctgatttgatttctaccattccataaaagatttttccggtctttaccggctgttttaccagttttccattttcttctttgtaaacaaaatcttccccgtctttttcccgcacatattctctgttcaaatagattcccgatgcatccatttcttctgccggaagttccatactgactgattcctgatttttcaacccctggacatcctgaatataagcagtaaaagaataatacgaaagggcactgttattactgttgctataattcgaggaaacaggataagttgaaatctcttttacttctgcctcaaatgaaacaccggattcatatgcagttccgcttatctgactgcccacttttaatttttctctttgatattcatccaccattccttttacataaataccctgtgtgctttggatttcaagaaatgcctctccgtctgtctgccctttgtctttgtccccgacttttttcaccacaccattgatggtactttttacttcctgattttccaattccttttcaatctgtgcaattttcaaatcactgcttttaatatctaattttacggtacggatttctgcatttgtctctgtaattgccttttctttttcttcttttgtataaccatcaattatagtttcctgcggaactgcctcagtaaattccatattctctaaaaattcatccgatggattttgtatttcttcatccggattttcatccggattccatttattgtattggtcttgttcttcggaattatcggctttattattggctttgttatcatccggtttatccgttttatcttctccctgattcttgttattatctaaaaccacatcatattttccaagacttgttttataccattttccagcttctaatggttctttgattttttctccatttaagtaaatcgctgccaaaagcactccatctggcttatctcctgttctgacttccaaaatacaatgcttcgctgctttttcttctgtctcatcctttgttgtaaaccctgccaattggttcaaaaaagctccctgtaccagaactccctctttacagagataacgatatggttcttcttttgtcccatcacctttatatggttttgcattttctgtttttccattcggacgactctctaacgtaatatcaccatagagtttttcgtaaacttctgcttctgtttccgatggttctggagtgtcaggtttctctggcgtttcaggtttttctggattctccggtttgtccggattttccggtgtctctggattttctggtttgtctgggttatccggattctccgactgatctggattttctacttctcccaaatttcctgactgttccggattctccggctgatttgatggttcttctgcccactctgaattatctgaatgactcaaaaaagtcagctgatactctgtatttaatgccgtattggtcactttctttttcttgatttttgccagtgtatcttccagcccttttttcttaatttgaagctgctggttgtttagtttttcagtctccaagttaatatgaaccagtgtcatatcgtaagaaagaagcggtgttccctctttcacttcctgtccctcctgtacgaaaacctcctgtacaatctgattttctgaaagctggactttctgtgagacatttgaagtaataattccttctaaagaactgctctctccccaaatcatctgcttgagttcttctactcgataaacttctacctttgtccggttaaatttttgaaccccaaaccagatgcccgtaccaatgactgtgacagatgccactataatcagcgcaagtttgatttttttatgcataaagtctcccctttactcctcactctctgtttctgaaatttcttctgattcttccattttccctgtatcatctgtactttcttcatcagatatcgtctcactttcctcatgagttgctttcataccctcttctaagaaatcctgcggaaatgcaatataatcactttcttctaatccggactgaatctcatattgataggtttcttcattatattctcccagtgttacatttcgcttttccagttttcctttattatcttccgtccaaacataaggtttactgtccgcatttacaatgtacccctcatccagccagattccactttgttcttctccaagatccttttcaatgtaaacatgctgtcctaacagcagtccgtctgaactgtccagcattacataaaaagaatacgaactcgacgtagtctctgtggatgttgctccatagtacatgttattgttattattttctgcttcatctgtattcactgccgtaaatgttccactccaggtctggttttcatccactctggaacgaactattgccttttccccttcctgaatctcagataaattctgttcatttacctttcctttaatccggtaatctccggttgccagaatcgttataaatgcattggaatctgaactatacatatctgttttacttccgtcattgatgctctttacaattccatcaatttcacttactactgttgcatttgcaattttatcctgcttttgagaaatttctacctgttttgctttcttttcatactctgattttttcaaatctgtctgcgcagtctgaatctgcgtcgtataagaaaatttttcgtcctctgccgcttttttcttttctttttcaagctgggcaatctgcgtttttaaattttccatctctccatcaaaacgttctatttcaagctgagcttcttcaagttctgtctgcgtctgttctgtattataaacaaacaatgccgttccaacttttacttcatctccggcttttaccaaaatctgttccacttctctatcagaacttttctgtacttcccatgtttcctgtggttctaccgtccctgccatcctttgaacctgagaagccggattcataagggaaacctgatagacataagccagctctgtattgcttgtttctgtctttcttgttccaaaatacacacctgttccaattactgctattaaaatcagcccacctgctattgttagaattttcttttttcttgtcatagaagcctccttttttcattcatccggtataccatgagtataccagattttaaaacatctgtcttttattccaaacaagtttaatcttaagatgccttaagagattgaattgtttgacattttcgcaatttctggtaaacttaaagcatatcgcaaacttactaaaggagacaattttatgattcaattccagaataagcgacttttttttgcagcttttcttcttttcttttctgttctgcttaccggatgcgccagcaaagaagaaaaagccatcagacagaccatcagctcagaacttgaccatctggtatcaccagatgcaactcagataaatacttatttatcgttccagcttctgtttccagatgcacagcaggatgactcgtctgatttagacccttctatcacagaaatttttacagaattctataaaaacttttcttacaaaatttcggaagtttcatacgacgacaaatctgcctctgcagatgttatcattcacaatttggatacgcatgcccttgcaaaagactacgcaattgctgccttaaaaaagagaatcgagggtgacgcaaatccatcccaggtggacttttccttaagtgactcttatctgctgcttgacaagacgctcaaaaatcatgattataagcaggtagaatctgatattaaaatccaactaaaaaagaaaaacaatgtatgggaaattgtggaagataccgactttgataatgagctatccggaaattttcttacttatatgtctgattccaacctgctctctccaaaacaggttgtcaaaattcactttgataccatcaagaaatttgatgcagaacagctcaaccgttatctctcattagacagtctgcttaatacagacaatacttataccagttccatcgcacacgcactagctgaacagattcataaatctttcgactataagattaaaagtgactctgtagaaaataattctgcaaaagtagtggtaaaaattaccagtacagattttacaagcatccttgagacttaccagaaacagatttctgaatgggtacagtcttccgatgcccttgaagccggactgcttggacgccatgaaaaaggcagagagttcttgttaaaagcaatacaagacaatactgcaactacaagcgaaacggttgaaatttcgcttacaaacgacggaacaagctggaagatgcagatggatcagaatcttgcacaggcgattttaggcggggtcagcagtactcttgcagatgtacaggaagatgtagagtaaaaaaaataccgaagactgtcttttacgacaatctccggtatttttttatgtttttatttttcttccgttgtttcttccggtaaatctactttgatacacagttctttcaactgtttttcatctaccacattcggagcttctgacatcagacaggaagcatcttttactttcgggaaggcaataacctcacggatagaatcttcttttgccatcaacataaccatacggtctaacccataagccagtcctgcgtgcggaggcaccccatatttgaatgcatttaacaggaagccaaactgattgtaggcctgttctctggtaaatccaagtacttcaaacattttttcctgaatgtcattctggtggattctgacgcttcctccaccgatttcatttccgttcaggacaatatcgtaagcctttgcacgaactgcacccggatcactgtcaatcaaatgtaagtcttcttccatcggcattgtaaatggatgatgcattgctgtaaagcggttttcttcttcagaccactctaataatgggaactctgtaatccatacaaaacggtattcgttcttgtcaagtaaatccatctggcgtgccatttcaagacgaagtgcacctaatatatcccataccagtttggttttatcggctgcgaataacagtaagtctcctgcttcaccctgcatcttctcaacaagtgctttcatttcttcctctttcatgaatttactgaaagaagattttaaagtgccgtcttcatgaattgcgatataagcaagaccttttgcaccgtatccttttgcaaattcaaccaatttgtcaattttcttacgaggcatactgccctgtccttttgcattgattccacggacacttccacccatttccagagcactcttaaatacaacaaactcacagtcttttacaacatcagagacatctgtcagttccattccaaaacgtaaatccggtttatctgaaccaaaacggttcattgcttctttccaggtcattctctgaattggaagctgtacttctactccaagtacttctttaaacagatgagccagcatacgttcatttacatcgataacatcatctacatccacgaaagataattccatatcaatctgagtaaattccggctgacggtctgcacgtaagtcttcatcacggaaacattttgcaatctggaaataacggtcataaccagagcacattaaaagctgtttaaaaatctgaggagactgcggtaatgcatagaaacttcccggatgaatacggctcggtaccagataatctcttgcaccttccggtgtactcttatttaaaatcggagtttcaatctctaaaaatccctcatccgctaagaactgacgaaccagtactgctactttagaacgcagtatcagatttttttgaaggtctggtcttcttaaatcaagataacggtattttaaacgtacttcttctcttgtcttgctgttctcttcaattgggaacggcggtgtctcggattcagaaagtacacgaagagaattggcacggatttcaatttctcctgttgccagattttcattgacagcaccggaacgtgcttctacatgtccggttactgcaatgacaaattcacttcttaattttccggctttttcaaatccttctgcatcaatatctccattttcaaagataatctgcataataccggaacggtcacgaaggtctacaaagacaataccgcctttattacggctcttctgcacccagcccataagggttaccgtgcttccgatttctgcttttgtaacttccgcacatctgtgggttctctttaaccctttcattgattctgccattgtaattcttctcccttaaattcacttagagctttcgtacatcgtaaatgatgtattagttgccgaaattaatcgttataaatttcttcgatgatttcatagccttcggaaagaagctgctctttttggaattttttatttttcttcatatatacgatattaatatttttacctgcttttctttcttcaccggcttttttaacaacctctaccagtttagcagatgagagttttttgtcaagcagatatgcttttttatctgcgcttcccggaactttaaatcctttttccattaacagcataacgattctctcaaatccaatcgaaaatccggttgccggtgtcggtgttcctgtgaattttccaatcatttcatcatagcgtccgccaccgcctacacttcctgcaaatccatcaatactgatttcaaagattggtcctgtatagtaagacattccacgaaccagtgtcggatcaaatttaatttcaaagtttgctgtttttgcttctaatacactttcgataattgttgtcatattgtctgcaatttccggtgcaaggaagccttccaatttctctttgcagtaaagtactccatcgattccatcactgattttatcaaataaatcaatgtatttttcaatgctttcttttgcaaatccggattcttcaagttctgctgcaacaccgtctaaaccaattttatccattttatctaagataataaatacctgatcataagattcttctgcaaatccactgtaagcagccattgcttttaagaaacgtctgtcattgatacggatagtaaagctgtcgaagtccagttttcctaccagagtagaagttgcaaggataacatcaatttcagcaagattggtcggctcacctaaaatgtcgatatcacactgcataaactgacggaaacgtcctctctgcggtctgtctgcacggaatacatttccaatctgaagtgctttaaacggagatggcagctcatttgcattatttgaatagaaacggcaaagcggtacagtcaggtcataacgaagaccgctgtctactaaatcattttcttcttttgcttcactgatttttaatttttctccacgttttaagatacggaaaatcagtttttcattatctccaccctgtttgctggttaagttttcaatgtgttctacacaaggagtttccatagaagtaaaaccaaactgtttgtaagtctctttgattaatccgattaagtaatcacggatttccatctctcttggtaaaatgtctttcattcctgttactggttttttctttaactgcatatcactttctccttttctttctcttcctcatgcattgttctttgaaatgcaagaaatattttcatatcaaaatttttcacttcatcaatgagcatttccattgccacttccggcgaaaatgcatctcgatagcttctttttgacgtcaatgctgcatatacatcacaaattcttaaaattcttgcgccaagcggaatttcctctcctgataaatttttcggatatccactgccgtcatagttttcatgatgataataaatactttcgagtataaaatcagaatatcctctttcttttaaactctcataccctaacttgggatgctttctgacatacttgatttcctctacaataagaggtttttcttcagccgtaatataatttctaagctttaattttccaatatcatgcagaatccctgcaaccgcaagctcatgacacattgtctcttccagaccaagcatttttccggttcgatatgccagattacttacctgtattccatgtttgatttctttttccagatcaaacgtaatcaaatgcatcaatggttcagatgaagcctcttgtattgcttcactcatcctgtgcacttcctatctccagatatttctttaatccacttcttttacgctcaatcatttcgtcaattctggaaatataattcgttacatcttttacattttctgcacgctcaatccgcgctccgtcttcaaaaacaaattttgtcgatgcacctgcacctgccgcaataatcgactgtttttcctccataatcagaatattataaattcctgccttatcctctttggcatacccgacattttcaagattaccggacatatttttctggcggtataaataatatggacccatgccacactctctggcacaattcattgccatatccataatctcctgattattttcaaaggacatctcctgatatcggtcttgaaacagatggagtctggttgcacgcttgattgccagtgaatgaacggtaagactgtccggctccatcttctttacttcttctaatgttttttgtacatctttggcgcactcacccggcagacctacaattaaatccatatttatattatcaaatccacattccctcgctaacgcgaaggcgtgtcgtgtatcctccaccgtatgtctgcgtccgattaaatccagcgttgcctgattcatcgtctgaggattcacagaaattcttgtaaccggatattttcgaatcacttcgagtttttctctggtaatactatccggacgtcctgcctctatggtgtattctttcacttcacgggtcgggaaacaacattcaatatgagaaagcaacctctctaactgttccggctctaaagtcgtaggtgttccacctccgatataaattgtatcaagtgtccgcactttcatggtctctccaatgtaagtcagctccttacaaagtgcatccagataggcgtctactttatctctccacttcgctaaaggataagagctaaacgaacaatagaggcaaatacttgggcaaaacggaattcccacataaagactatagccatttttataatcaatgtctgctaagagtgctcgttcccgatttgcaattgtaatcgccagtgctgtcttttcattactcgtataataagtatttctcataaactcagcggtttccacattgctcattccactttcaatcagtcccattgcaatctttgtcggacggattccggttaaatctccccatggaagcactttttttgtttcttttgaaagtccacgatacaatgcctgctttaacttattttttctctcttttcgctcatcatccgaagccaaaaaaatcgtttcctcaaacaccgtttctttatttttcaaaatttccagtctggtatcttccttgttataggtgattttcaccacaagaaaagcttcttctttttcttgaaaagtttctgttttttcctctccctcataaagaattgaaacctcttcctgaggataaaacgctttaatcagagtatacgcatcatactcaaattcttttttattaaatactatgtctatcatatagattcctcttttgatactttttatagataaggattatatgatttttcatgacgaatactggtttcatttccatgtcccggataaatttgtacttcctgcggaagatgatcaatgattttatgaagactaatctgcatctgcgcaaaacttcctcctggcaaatcgcatcttccacagtttccttcaaaaatagtatccccgctcatgagaagttcttcctcttcaaagtaataacaacaagaaccttctgtgtgtccaggagtcagatacatgcgaattttagatcctgcaagttctatctcctgtccatcttccaaatattcatctgcttctaccgtatatcctcttccttcccattcaagagaaagattaatttcaggattggaaagtgtctctttttctgcttttgatgcaaaaattggaattttccattcctgtcttaattcatttactgccatcatatggtcataatgtccatgagtcagtaaaattgcaactggtttttttcccagtttctcaatcattttgctaatgcgttctgcttctgcacccgggtctactaaaatcaactctgtcgtctctttgttttgcagaaaatagcagttcgtcataaccggtcctaccacaagtgacctgagatttaagttcttcatcgctttgctccttctctatctaacgtactcttggaatctttctatgttaatttcgcaaaaaaacatggaaaattccgagagtacatcctatcaaccggttgttcgttcaatatcttttacgctctctatctgtctgatttttgtaatcagactctggagctcttccttactctttacatcaaatgccagactgatggttgcaattccctgtttgcttgttctggtattaatcgatgaaatatcaatttttcgttctgtaaaaatttttgaaacatctacaatcaagccggtacggttatacgcataaatcgtaatctctgccgtatactgttcattttctccaccgcctgttgtactctcccattctgcttccatcagacgctggcgttcttctgctgacatatttaagacattgacacaatccgtacgatgaatcgtaacaccgcgtccacgtgtaacataagctacaatttcatctcccggaagcggattgcagcattttggataacgggcatttaaatcattcattccttttataataatcccgctttttcctttatgtggacgaatcttttctttattgttctctgatgctgcctctaatactttctcatcagtcagttctgccttatggtctttattatacagctctaacagcttatttaaaacctgaccttcttttaaaccgccatgtccaacggcagcaagtacggagtcccagtcacggaaaccatattttttcataacggcttccagatatttctgctttgtcagatttccaagagaaaaaccttttacttttgcatactggttcaacatctcttttccttttaagatattgtcctcttttctctcctgtttaaaccactgattaatcttatttttagcctgtgtactttttactacttttaaccagtcacgacttggaccttttgagttctgtgaagtgataatctcaattctgtctccatttttaatcacgtactcaatcggaaccaattttccattgacacgcgctccaaccattttatttccaactgcactatgtacattgtacgcaaaatcaatcggagttgagccatttggaagagtcttaacatctcctgccggtgtaaagcagtatacactttctgaaaataaatcaaggtcattttttaacagactcaaaaattctttattgtcagacatatctctctgccattccagaatctgacgcagccaactcatcttttcttcttcctgacgagttgtattttcctttccgccattattggaaacctctttatatttccagtgggcagcaataccatattctgctgttctgtgcatttcaaacgtacgaatctggatttcaaacggctgtcctttcggtccaatcaaagttgtatgaagcgactgatacatatttggttttggcattgcaatatagtctttaaaacgccccggaaccggtttatacatttcatgaataattccaagacaggcataacagtctctcacggtatctacgataatacgcactgcaaataaatcataaatctgatcgagtgttttatcctgattgaccatctttttatagatgctgaaaaaatgtttgacacgtccgtcaatctgtgcatgaattccagcattctcaatatgctgtcttacctcttttacaatctcgcccacaaaaagttctctttcactttttctgagattgattttttctaccaaatcataatacacatctggtttcagatattttaatgacaggtcatctaattctatttttacttttgaaataccaagacgctgtgcaatcggtgcatagatatccatggtttctctggctttttctttctgcttatgaggcggcatatatttcaatgttctcatattatgcagacggtccgccaatttaatcaaaataacacgaatatcttttgccatggcaagaaacatttttcttaaattttccgcctgcacttctatcttgtccgccgagtaactcaactgtcccagtttggttactccgtctaccaaaagagaaacctctgcactgaactcttcggtaatttcttcggttgtcataaccgtatcttcgacaacgtcatgcaaaagccctgcaacaatcgtctctttatccagctctaaatctgccagaataattgcaacacaaagcggatgaataatatagggttctcctgattttctcagctgtcccttatgcgcattatttgcaatctggtacgctttttctatcatggaaatatcagtagacggatggtacttctttacacttgaaatcagttccttatataaaatctccggactggtaaaatcttccatggttttgacgcttgcatctgcttttttaattttagcaatttcgtcgtcctgaagcgatgatgtatgatttttttccatatcttcgttcacctgatttctattttccctgatatttgataacagattccacgtcatatcctttcagacgttctcttccttttaatccttccagttccattaaaaagataacttttacgactgttccacctaattcttctaccaatttggcagctgcttcaatggttccccctgttgcaatcaaatcatctacaattactactttctgacctggcttaatagaatctttatgcatttcaatagttgcacttccatattccagatcataacttttttctactgtctcgcaaggaagctttcctttttttcttaccagaaccaacggtttatgtaagttatacgcgattggagctccaaaaataaatcctcttgattctgttcctacaataacatctgcatccgtatcttccaaaagtgcctgcatggaatctactgctaactttaatccatccgcatcctgcaaaatgcttgttacatctctgaaaataattccaggctccggaaaatccggaatacttcttacatattcttccagctttttcataattcgttcttccccgcttcctcttttatattttcgaatttgtcaatttaaatcgaatttttaaatgtgatatttagtataacatcttttcatttcgggatcaaatataattttgcacgataatttcgatagattcccgtccattgtatgtattaatagacggatagtaggcaattgaccaacgttctttctcctgaatttcatttacaaacgcttctccatctccaaaccagactccatccatgcagattccgtttttatcgtaaagcttcatttttactacgttcttattttttccaaaaattctgcactgtgtaatttttatatttttctctgcaaaaaccggcttattgtttccctttccaaatggctctaacaaagaaagctgacggatgagtggaagtgtcacataagaaatcggcatcggtacatcaattaaaactttttccatcatatcttcctgtgttaatgtgcattttttatttaacgccctacgaaatgcctcaatattttcttccggcagggaaagtcctgctgccatcggatgacctccaaacttagaaagcaaatctttacattttaccagttctttaaacatatgataagtttcaatcgagcgccccgaaccttttactccgtcttttccttttgtcaatacaatgactggtttgttatacgtctctcgaattcgtccggcaataattccggccagactttcatggcagtccggcagataaatgaccaacaccttgtcctcttttaactctgttgtctctaccagcttttcggcctgttccacacctttttgcgtcatttctttcctgctgtcatttagcgcttttaattcttctgccagttcctgcgctttttttgcatccttacaaagtaagagattcaacgctttttttgctgtacttaaccgtccgcttgcattaatacaaggacctaagacaaacccgatatgataaccggtcagttctgcctcttctaaatgattgacacgaattaaggctcttaaaccataattttttgtatttttcattcttctaagtccttcttttacaacaatgcggttttcatcctgcaaatccatcacgtcaccaaccgttgcaatcgctgcaaattcaataaactcttcctgcgcttcttttggaaatccttttttctcatacaaaccacaaatcagcttgtatgccaccattgccccgcaaattcctttaaacggatacagacacccttcctgctttggatttacaatcgcatccgcaggcggaagaattgttttgatactgccatcttcctgttcctcatatggaatctcgtgatgatcggtcacaatcactgtcattccaagactttttgcataggcaacctgttccatggcactaatcccgttgtcgcaggtaataatcgtatccgttccagcctgataagcaaggtcaattaattctttgctgattccatacccatccttgattcgatccggaatatcaatatctacgattgctcctgctttttttaagccaattaatagaatataagtcgagcatacgccgtcaatatcataatctccaatgattcgtatttttttcttttccccgattttttccagtaaaagctccagtgccttctccattcctttcatcaactgaaacgaataaatctgattcatccctccatgcagatactgttcaatttcttcttcacttatccgttccctgtttctaattacccttgcaatcactgggtcgactccaaatttcctgccgattccataaaaatctgccttttttgccaaaaccatccatttttgcatgtcatttctgtccttatcttcctgttttttcttctattatatatactataccacacttatacaatgatacaaataaaaaagagactgcttttaaacagtctcttcctcaatttttatttctttttcagttttgttctcatcacataccaaagtgctccggtaatgcatacagaagaatatccaccgcatacaatacctaccataagcggcattgcaaattcacgtacagaagagacaccgagaacaaacaggaagaataccatgataaaagtagtcagagaagtataaatacttcttgttaaggtctgggtaatactggtatttacaaccagttccaaatctttcttctttcctgctgcctttaagttttcacgaatacggtcgaaaataacgatagtcgcattaatggagtaaccaacaatggtcagcatacacgcaataaaggtagttcctacggatactcgtgcaatcgcatagaacgccagtacaaccagtacatcatgaatcagtgcaagtacagcgcttcctgcaaaacggatatctttaaagcggaaccagatatataacagcatcaaaattgttgcaatgatgactgcttttactgcatcggaacgcatttctttacttactgtagaagaaatactttcacttgtaattaaatcagggtctacatcaaagttttctaccagtgcattgtctaatttctctcttgtttctacatctaaagtaatagtcttgataattacctgattacttcccactacttttgtcgcctgaatatttttatcaccggttacttcttctacaaccggtgttactttggaatcaatttcctgaatggtcatatcttccttaaaggttacattcgtagaagtaccaccctgaaattccaggctgtattttaacgcacttcctgttgtcttaccaaagattatcatagctaccggtgcagaaagcactaagatcagagaaattataaagaaaattttcttttttgcaagaaaatgaatcggttctctttctttttttacaccatagaattttttatctctgactccgactgcgtaaactgcatacataacaaagcgtgatacaacaagtgcagtaaacatggataatacaataccaagtgccaatgtctgtgcaaatcctttcacagaacctgttccgagccagtttaatacaaatgctgcaatcaaggttgtaacattaccatctaagattgcagaaaaagccttctgaaatccgctcttaattgcagtctgaacgcttttaccggcgctgatttcctcctgaatacgtgcatagataataacatttgcatccactgccataccgattgaaagaataataccggctacacctggaagagtcagcgtcaaatcaaacgcatttaaacaaattaagtcaaggcaggtatagataatcagagctacaccggctacgacaccaggtacacgataaaccagaatcataaataagataactaaaatcagaccaattgcggctgcttttaaactggttgcgattgcttcttctccaagctgtgctgctactacattggaacgaagttcttttaattccagtttcagaccaccgatacggatggtagatgccagactttctgcttcttccgcatttttcattccggaaatctgagcttttccgtctttaatttccgcatttacactaggtacacttacgaactcaccatcataataaataccgatggaatcatggctgtcctcataagccgcctttgttgcttccgcaaatttatctgttccgtcttttgtcagtgttaaatcaacaacatttgtattatttttcaagtcatcctgcacgacctgtgcgcttgccgtttttacatctgttccggtcagcacaatcgaaccgtcttcttcaagttcttcgatggtcttatttaaggtataagtaataccatctgttgttgaataattttctgttccgtcagaacctttatgtgcaataaagtaaagagaacctggtgttccgagttcttccagaatcgcatttgcgtctgttacatccggaatttccacgttaatacgattgtctccttctttgtatacctgagcttcactactgtagttttctacacgtttctgaagcttataaatggtatctgacatctcatcatctgtaggattcttttttgatgcctcataagtgatactgacaccaccggaaaggtcaagaccgcgtttaatattctttgcggctcctgttcctgttggtcctaaaccgactgctgatgtaaagactaaaaatgcagtcataaacaccgtcagtatcagcacgagaattcctctgcttttcttcatgatttttcctttctttgctgattgcctcttaattctctgtcctgtcttactcttcttctgccatagccgcttttatcataatcgcacattctactctttttctttgcagttcacagccgatttcataaacatcatcaattctgcctgtaaaattataagagtttgcagcacatccgccactacaataaaatctggcaaaacagtttttacatttttcctttgcgtagacattacagtttttgaattgacaggaaatttccggtttcttaactccgtcccagacatttcccataaggaattcttcctcaccaacaaactgatggcatggatataaatctccccaaggagtgacagccagatattctgttcctgaaccgcatccggacagcctcttgtatacacaaggacctcctgtcaaatctatcataaagtggaagaagttaaatccttttccctctttattgcgtcgaatcatttcttttgcaagcttatcatactcttcacagatttttggaatatcttcttttttgattgcatactcttctttttcatctgctacaaccggttctacagaaatctgttcaaaaccaaggtcagccagatgcagtacatcttctgagaaatccagattatgatgggtaaatgttcctcttgcataatatttctgctgccctctgctgtctgcaaacttctggaatttcggaacaaccaaatcataacttccttttcccttacggaacggacgcataaaatcatgaacttcttttcttccgtcaatactaagcacaacgttgtccatttcttcattggcaaactccatgatgtcatcatctaagagcacaccgtttgttgtcaaagtaaaacgaaaatgtttattatgaatcttttcctgtgaacgtccataagcaactaattccttaacaacattccagttcataagaggttctcctccaaagaagtcaacctcaaggtttttgcggtttccggaatttgcaatcagaaaatcaagtgcctgttttccgacttcataagtcatcagggctcttcttccatgatactctccctcttccgcaaaacaatatctacatgcaagattacagtcatgcgcaatatgtaagcacagtgcttttactacggttggacggtctttaaagctctcaatcgcattttcatagatatcatttgtaaacagcatctgcgcttcttctaattcccgacattcttcaattgctgtgcgaatatcttcttctttatattgatttttaaatttttccaaaatggctgcttctgacattttttcttccagacatcctacaatatcataaacaatatcatctaccacatggacagagccactatttacatcaagtacgatgttataaccattatttttataacgatgaatcacaactttatccctttctactcttctctaaaacaggaaaaagaatcctgcaggcaggattctttttcctgtttttattgtttctaaaaaatactattatttgttttcgcagctctggtttcctactgtacaggatgttttacaagctgactgacatgaagtctggcattcgccacatccacctttttttactgtgttctgtaaactttttgtatttaatgttttgatatgtttcatcacatattcctcctgtattgatacaatttttacgcctatgcgctttcgtttattatagcataggaccttatagataggcaagtatttttatttaagacaacattcccccaagtgcccctgccataatgcatagtccataggtaataagaaactctttcagatcaccttgtatcttgcgctcggttatccatgtcactacggttaaaagcagagcgtaagaagcccccagtcccattccccacaaaaagcagtgctgtctgatgctttttccaagtgcaaagcttcccacaaaacaggacaaaatgtatgtaactaaaattccaagatgaatctggttttcgtttaactgaaatttacaaagtaaaaatgccagaattaacagcagcaaacctgttacaagatatgcgacaagtaacatttttatcatctgtgtcaatttagattgtgtttttacgctttgttccaaaaaaatccctcccatgtttatagatgtacttttcatcatataatctataatatggaaaggacttttattctatcacttattttttcatgtattttctgctttttcttcttctctttctggtcaggtctgcttttaccataatcgcaaacgatgcaaccgctgtacccatccatgcaaagagattcatactgtctcctgttttcgcattggaagaggcacttgtggaagcagttgtactttctgacactgctccactaccctgtgatgtcaaaagtattggcttttcaatcggtgttacagaagaatcactctgaccggaactacttctatttaaatttgttccaattccgctcgatgcaaccactataccggatttcaccgaagaatctgtactgtttttcttcgtaccggaattagaggctgtctttgaggatgccatcgtatttcctgctgccggaaccattgtcagacttcccgctgtcgcatcactataataagaaacacttggcttatgatttggactctttgttccaattccgaccaactgatttccgcctatattaaatgggctgaaagacgctgtctcaaacaccagatatccatctgcaagattcagattctgtccggcgacaaagtattcatactctcccttttcttccatgtaatgagcaataatcaaggattcataaagctgtgccccttccggaaccggaattctcaccgtaactttctttccttccggaacttcgtattcttcatcggtttttaaattccaaagcgtaatctcatagctttttaaaattgcctcgatatccacctcttctatatcgctatctgtaatctttgacactcgtaaatccacataaggtggaagaaaatctccgtctactttaattcctgttgcactgtcttccaggtttccaattggagctttctcttcggtctggtctggttctgctgtttcctgattctgagtgttcctgacagtctgttcaccagttattttgtttgaagtttcaccagaagcatctttctcttttccagtattttctgtctcctgaatttgctgttcccctgcattttcctgtgcgccttcttcagaaccaactgtttctttcgtctcctctgtcgtttccgattcattctcggaatcacttggggtttgttccgaagtatttttattctcttcctgtacggtatcttctgccgggttttctgttacagtctcattcttattttcctgtgaattctcatccttagcttcttcttttgaactttcctgctcgccttgtgcctcctgcgattttaaagaatctacaaacacagtaatgtaacggactacttcctcgccctgttcactccagccttccacaccggaataatcatacgtctcaatatcatttggtgtaaaaataatctgctgctggctctgataggtatccatcactttatccggctctgcaaagcgaaatgttccatctccggaaaaattttccgttaaagaaagtgtatttaacgcacctggttcactcatagtcaaagaacccggaaagacaacttccggtgctgttttctttttctgctctgtctctttctgattcgattcctctgcgtctttcgaagcatcttctttcgtatctgttttttcagaactttcttcttttgtgttctcttttttggtatcctggtctttggtttcaccctgctctgctttttgttcttccttctgacccactacaaaggcagactttccaaggtctgcctttgtagtatctacatcagattcatttagccatgcataagttaaggttacttttcccttgcctgtaactgaaagaattggtcctgtaaagccctctgcacggctcacttcaaactgcgtcggcatccgaagcgttgtctcctctgaaatggtaatcgttccacaaaccagaatttttgctccttctgtagataattcttttgctttttccagcgaattaaccgcatttgcctttgaagtaccgtcaccgctgtctgatttggtaccatctacataaatcattcttttttcctgattctgttctgatgcagcagatacttgtgtgatatgtaatccgttttgtggaacagctccgctaagtaccaatgaagaagccaatgttactcccattaaagttttatatatttttttatttctattcataataatcagattaaaatcctttcgtaaatcaaagcaatttctgtggtctttcatcttccactttatatccgacatattatagcatacttttgcttttttcaacagtccccaaatttatattttttgaaaaaagccattttccttgcaatcccatcaaaaatcatgtatcatagattaaataccatgctggttaaagtttttttccggcgaatttaaacaaaaaggagtgaagattcattggattccagcgatgccatacagtttctcattttgattatcctactggctttatctgcatttttttcatctgcagagacatctatgacaactgcaaaccgaattcgtattcaaagtcttgctgaacttggtgataacaatgccaaaatcctgcttaaaataaccgataattccggaaaacttttaagcacaatcttaatcggtaacaatatcgtcaatattggagcctcttcccttgcaacctctatggctatccgcttttttggaaatgcagccgtcggagtctgcaccggacttcttaccctgctggttttactttttggtgaaatcaccccaaagacacttgctacaattcatgctgaaaaaattgcactggtttatgcaaaaccgatttatgcgcttatgacggttttaactccggttatttttatcgtcaatcagcttgcacagggaatccttaccattcttcgggtggattccagtaaaaagggaagcaccattacagaacatgaactgcgtaccattgtaaatgtcagtcatcaagagggcgtgcttgaaaatgaagaacatgaaatgattaataatgtattcgatttcggtgattctttagcacgtgatattatgattcctcgtattgacgtcacttttattgatgaggacagttcttacgaagatttaattgagttattccgtgcacaaaaacacacacgtttcccagtctacaaagagacaaccgaccatatcgttggaattgtcaacgtcaaggatttactgctcttagacaagcaggaagaattttgtttatccagtattatgagagaaccgtattttacctttgaatacaaaaaaacttctgaactgcttatggaaatgaaagaagaatcagtttcgtttgccgttgttttggatgaatacggtgcaactgccggaattattactctggaaaatctgttagaagaaattgtaggcgatattcatgatgaatatgatgattcagaagaggatgatataacagaaatcattccagacagagaatacatagcaaaaggctctgcacgacttgatgatttaagtgattttctccatgttaacatggactcagaagattatgattcgattggcggttatattattgaacagctcgatcgacttccagaaaccggggaatctgtcacaacccctgaccagatacgtctggtggttgacaaaatcaaaaagaaccgaattgaaaccgttcatatttatcttccggagtctttgcacagccagactttctctgacaaaaatgacaaaaatgacaaaactgacaaaactgaacattaacacacagaaagaaggattgaaacaacgatgagtagtttttttaatatggacagtccggttatgaggttcttgtcccgtttatgtgatttgatgattttaaatattttatgcctgatttgctgtattccgattgttacaattggtacatccattaccgcactttattcggtaactttaaagatggtaaaaggggaagattcctatattgcaaaaggcttttttaaaggattccgccaaaacttcaaaatctctacgattatctggctgattctgcttgttatcggtgctctgcttgcctttgactttcgtgcgacaaatatgcttccggctgctttccagaacgttttccgtgttttggtcggtgcatttattacattttatattttgctgttttcctatatctttccatacattgcaagatttgaaaacggaatcaaagataccgttaaaaattcagttttaatcagtatcttaaaccttccacgtactcttttaatcgtacttttaccaatcggtctggttgtctttacattcttaaccaagacaaccttagcttatggaagcctgttatggtttttaatgggagtttcctttgttgcttatgtaaattccatttccttccggatcgtatttgcaaaatatgaaccaagtgaagacgaggaagaaccctcatttgattctgaagaagtaaacgaaacagcaaacgaagaaaaataaattttttacaggtcaggtcatagagtaaagcggatattcgcaatccgcttcgctacttgctcatgaatgttcaacttgaatctatgacctgacttctttttttatctcatttaaaatttcatgaaactgacttccacagcgctctacttctccaagcacagtctcaatcccctcttttgataaataccagttctcggctgttatcgggctttcttttgccggacacacgaaaaattcaatttccggatataagagttgataatacaataacgctcttcttgcatgatacggcatacagcagagaatcgctttttttacttccatcccttctttatccgtcactttcttagaataaattgcattttcataagtatacgttgcattatcttcttttaagatgtcttttttatccactccgttttgaactaatacctgctgtaaaaattcccattcagtttcaaactttccctgatacagttcttgtttttgcaaaacccctgcaaaatgaccaagcactacactataatgaccggatggcagaagcttcttcgcaaacccttctcggtataactctgcagcacgctcagatgggtttggaaatccatttcccggaataaaaataatatctgctttttgaggctcttggtctataaaaataaaatctgttatctgctttaaaaatttttcatacatctgtcttatcctcttctgatttcttatcacatagaaaaagaagccggtttctccgacttcttaaggcttctatttcattttcattcatctgcaaaaattacattgcgataataattccgccatcatttgcgtacatactgctgacacccgcagtatctaacaaaaccacatcttttaccggaatccgctctaaaattgcctcttttactgcctgtgcacgtgccggacagttacaatgactaattcccagcaccttttctgccggatttggtgtgcgttctaccacataatcaaccattttcatcactgctttattcattcctcttgcctggtcaagctgaacaatcgtaccttccggtgtagaacccatcactggtttgatttttaaagcagttgccacaaatgcttttaaattgctcaatcttccatttttacgaagtgtttcgagcgtttcaagcacaaaatacgtattctgttcactgatataggcatctactttttttattacttcttcaaattccatcccctgttcttcacactcttcaatttttaaagcaattaaggtctgtccaaccgacgcagagcgagaattaaacacatgaatttttttatccggatgtgtttcctttaataaattcattcccagaactgcgctgttataagaaccgctcaattcagaagaaagtgttactgcatatacgtgttctgcctcacaatcatacgctgacatataacgttctggtgacgggcaggatgatttcgggcaatttggactctctgcaactcgttttaaaaaatatgcctggtcaaaagtatcatcatctataatatcttcatcatccacggtcagtgtcaacgatgctctttccacagccggactgtctttccatttttctactaattctccacaactgtctatcacaattttatatctcatattgcaccctcttatatgtagtttctaatactatgttttataataccataaaacactatacttgaaaaggctttttccttaaaaagactttgatttttttaccgaatcgtttatacttaaaaaagtaaacacaaaaaagatgaggtttttcaatgattgcattaaacgtacaagatgtcaaagattttatggcacggctcttaatttcagaagaatttgactcattctggctctgtgaggcttcaattaccacattttcgacctttcaaattgatggaaccctgcgccctgaattttttgacactgaagaagccgaagcccttacaaaaagcggtcgcacccattgcctgtggcaggaagtaaagccctactgtttttctattatcaaaggaaaaaaaacaccgctttcctttaaaattgtatttcaattatccagacaggcttccgaacagcttctcttaaaaaatgcttcaaactggagcattaacgatatttatgggctttatttaaatctgcagtatgatggtacttccctaatctgtaccaccggcacttccatgaaactattttctatggataaatcactggatcttctctgggatgaagctgtcatcacattttttaaaaaacaccagattgccatgctttctgtctaaaacatggcatataaatgtaccacaaagtgaaggttaaaaagccttcataaatatctaacataactttacaggaggaattttacttatgatacaagatatttacccacatatttatcacaacgaatatacccctcacgaaccaactcctgaagatattgttcttcattataaagacaacactgtttttgtaaaaaaagaagaacaaaatatttcgtttttaaaattctctgaagttgtttccgtttatccaaaagcaaaagaaacatttatctatctgttttctattgataaggtttcttattatcttatccctgaacttccagaagctcttttttcaaactatcactttgaaaataatcgtcttttccgtactgcacgaccaaaagacctcgcctttgccggaatcaccggatggcagttatttacatggtacagtgaacacaaattctgtggaaaatgcggttctccaatgaaatcagatacaaaagaacgtatgcttcactgtccgaactgcaacacaatcgaatatccaaagatttgtccggcagttatcacagcagtacgaaatggaaacaaactgcttttatctaaatatgcgggtcgtgaatacgttcactacgcactgattgccggttttaccgaaattggggaaaccattgaagaaaccgtaaaacgtgaagtaatggaagaagttggattaaaggttaagaatctgcatttctataaaagccagccttggtctttttccggaacactgttatttggatttttctgtgatttggatggagaagatacgatttctcttgatgaagaagaactttccatggcagtctggatggaacgtgaaaatattccggatgacccggaacaaatcagcctgacccgtgaaatgatgaccgtctttaaaaacggagaagataaaaaatactgttaactcttaaatgaaacaaaagtgcccctgaatttttctacaaactcagggacacttttttatggttcaccttattattttgtcatttccatcataatttcattgcttcttgcaacaaattttgtcatctcttccggagtcagctgtctatgcgtaatcacagctaaatcatataactgctcgcataccagtttggttaaatctccttctttgtttgccagcacatactgcaccagtttattatttaagtttaataccagtgtttcctgtccgccaaacatagaggaatccatgccgtacatattgtacatcttcatcatttcctgcatacgacggctttcttctgtcactgtcatcatagaagaaacactttcgtttttcagcttttcggcttttactgtcagattttcttttcctaatgctttcttaaagatttcgcctaactctttggtctgctcttctaagttttcttcgccgtctgcttttacagattcattgatgtctgcatcaatacgcatgaattttacagtttcttttttctgctctacatgagaaataaatgcagaatcaatgttatgctttaagatgagcgcatcctgtccctcttctttaaacatattgatgtactggctctgctgtacttcgtctgttacataataaaccgttgttttttccggttcttttccttcttcagcatcttttttaatttcttctgctgtttcttctttattctcttcgattactgtttcagcttcctcttttgcctcttcttctgtctcattttcctttaagtaatcttccagagtcaggtattttccatccagattcttatacaggatataatccatcattctgtctgaaaatttagtgtctttcaaacagccaaatttgataaacggattgatatcatcccagtatttttcataagtttcacggtctgtcttgcacattccggaaagtttatctgccaccttcttactgatatattcagaaattttcttaacaaatccatcattctgaagagcacttcttgatacattcagtggtaaatcagggcagtcaatcacgccttttaacaacattaaaaattccggaataacttctttaatgttgtctgcaataaatacctgattgttgtataacttaatggttccttcaatggattcatattccgtattaattttcgggaaatataagataccttttaagttaaacggataatccatatttaaatgaatccagaataacggctccttataatccataaatactttacgataaaattctttatattcctcttcggtacactcatttggatgtttcatccacagaggctgtgtatcgctcaaagaaaccggtcttttgttaatcttaacctggtcttttgcaggagaaacttctacaacttctttttctccattttcattttctttttcttctgttttggcatcttcatgaatatgctctacaacaacatcatcttctcttaagtcagcttcatcaattgtttcatattcctgcggagcatttgccttggaaagataaatctctaccggcatgaatgagcaatatttttcgataacttctcttgcacggtattcatttgcaaactcaagactttcttcatttaaatgcagggtgatttcagtaccgacttctgtacgattactgtcttcaagttcatactctgtaccaccatcacaagaccagtgaactgcctgtgctccctctctgtaagaaagagtatcaatttcaactacatcggcaaccataaatgcagagtagaatcccagaccaaagtgtccgataatctggtcttcatttgttttatctttatatttttcaaggaactgggttgctcctgaaaaagcaatctgagtaatgtattcttctacttcatctgcagtcataccaagaccggtatcaatgaatttcagggttttttcttctggatttacaattacctgaatctgatttttatgattttcaggaaatgtatattctcccattacctctaatttttttaattttgtaattgcatcacatccgttggaaattaattcacggaagaaaatgtcatggtcggaatataaccactttttaataattggaaaaatattgtcactgttaattgataaactaccacgcttactagccatgatataaacatctccttttactttctctttttgcagaaaacttctcttttctgctgctaaaatcaatattaatacttaaagagtaaaaagtcaagaaaaaattagcactcattttggttgagtgctaacaaatttttataaattttctaaacaaagaataaaatctatgcaatttcacaggtgttcgattggaacatcaaaaaatagttatctcaaaaacaaatgcaggaataaattcttatactttcgataaggaagatagcgaatcggaatatctattttactttttcttacaagcagactctttttatgactaaacgtatcaaatcccgcttttccatgataacttcccattccacttgcaccgactcctccaaatcccatataggaagttgccagatgtactatggtatcattgacacatccgcccccaaaggaaagctgtgagagcacctgttttttgacagactgctcttttgtaaataaatagagtgcaagcggtttttccttttgttttaccagatttacggctctctctatggtttcaaatccaatcaccggcagaatgggaccaaaaatttcctcctgcatcaccggcgcatcaaagtcagtttcatttaaaatagtcggtgcaatctgcaaggtttcttttcgtccatatcctccgcttacaaccagttcttcttttaacagcttcatcagcctttcatagtgataacttgaaattattttaggataatctttgcactttaacggttcttttccgtacattctgtgaatccatttacacatttttaaaatcaattcttcttttacggattcctgaaccaacacataatccggcgcaacacaggtctgaccactatttaaaaattttccaaacacaattcttttagccgcaagatttaagtccgcactttcttctacaatacaaggactctttcctcccaattcaagtacaaccggtgtcagctgttttgctgcctgttccataatcagttttccaactcttggtccacctgtataaaaaataaaatcaactttctgctctaacaactttttattttccttttccccgtctttgattacagctacaaactctaaaggaaatgcttcttcgattatcttttttatcattttaaaagacactgtcgatgctccagatggttttatcacgcaacagtttcctcctgaaattgcatcaataagtggctgaagacaaagcaaaaacggataattccacggtgcaataattaagaccacaccataaggctccgcaattaccatactttttgccggaaactgagcaaggggtgtcggcacccgcttttctttcatccagctggccagatgtttttttacataacgaatctcatttaaaagaaggcctgtttctgtcatataactttcaaacgcacttttatgcaaatctttttttaaggcatctgcaatttctctttcatgttttttaattatgatttcaagcctgtttaatgcgttctgacgaaattggattgattttgtcgctcccgtctcaaaaaagtttctttgctcttttaagattttttctatttccatgcagtctgcctcactttcttttttaatcacccaaaatatttaaaaaacaggcagtctttcctaacgaaaaaactacctgccttcttttgcctcttagccctctacaatcaaatactgaccatttggaagggcaaatacttcactggcttcttcaagttcattcatggacatttcatcgacatccataccattttcttcaaaatattcttttacttcttctaaagtatccacaacaactgccatacaatcttctaaaaatgcttctgcttcttccacagtttctgcaaccggctccggaaacagttgttcctgatttcttaaaaatgtaatcaagcactcctcactaaattcattcattcgtttttcctccttaatcctatcatctttttttcaaaaaccgttttcacgtgttttgtactcttatctcagatcgagatactccctttgaaaccttaatggttatgctgtcacacatttttatgcgcttttgcataagccagaatttcttccggtttgtctacaattttatctgcatgatgttcttccaattctcttcttggacgaaatccccaggtcacaccaattgtaaacattcctgcggcatttccggtatccatatctgtattggtatctcccatataaagacactctgaaggtttggcattgaactctttcgcaatcgcaagtggtccaagtggagaaggttttcttggaatttcggcagtctgaccctgcactttatcaaacaattcttctccaaatattttatttaccacatctactgctgcatgatgtggtttatttgagcagacacctatcttaatgccttctttttttaatccatttaacatctccacaatgccgtcaaacggctttacatgataaaacggatcctcttcaaaccatttgcggtaaatctgttttgcttcttcataatcaactttatctattccgccggatgcctctaaaattcttcttaccagctcatctgccccatctccggcaaaaaaattatatccttctaccggctgttctttaagtccataatggctcagcagacggtttcccactaccgcaatcgattctaccgtatctgcaattgttccgtctaaatcaaaaatacatgcttttatcatttgttctcccagtccttccagctcattcccatattttttacttcctgatataatcttgaaatcggcatacctaccacattataataatcgcctcttatctcttttataaattttgcacagagtccctgaattgcataagctcccgccttatccatcggttctttgctctgtacataagttttaatttcttcttcactcattggataaaatacaacttctgtcttttcaaaaaaagtctgttttgtctctgcctgattttctctcacaaacagactcactcctgtataaacaaagtgagaatttccctgaagcttttttaacatagacaccgcgtcttcttcatctgccggttttccaagaatgtttccatccacagcaactacggtgtccgctccaataacgcagacatctcctgttgtttttgaaaatacgtcctctcctttttggctcgaaagctccatcacgacttcttctggattcgtgcttgtaatgacctcttctgcttcacttttacagacttcaaatacacatcccatctgagtaagcagttcttttcgtctcggtgagccactggctaataagattcttttcatatcttaagttctccgttgttattcttttgaatgtaaatcattgcttctacattcttaactcttttttagtataatatttcttcgtcctacatgcaatatcttttatttgtaaaaaattcatttcacattcttgttaaaatgtattataatggtaataataaaaacagacagttagaaaggacgtatgtatatgggtagtttttataagaaagctttaggatttggagcacttggagctgcagctggagccgttgcatattatctcaaaaaacaaaaagaaaaagaccctcagcttgaagaggattttgcagattttcatgataatatcaaagaaaccgcttcctctgccgcaaacgttgcttcccgcttaaaagaaaaagtggaacaaaccgtagaagaaaccgttcagaaagtaagagaacatacggatgatatcctcgatgatttagataaactcgatgatgaaactatctttgaggatgacgaattttttgattctccgtctgacacctcagaagagtttgaatcttccaaagaagaagaggacttcaaaccagtcgaagaaagcaaagaagaaccaaaagaaacagaaacagataacgaagcagataaagaaaacgaaatcgaaaaagaagaaagcagtgaagccgcagcggatgaaaaagattctgataccgatgcttccaaagaaatcgaactttaatatgaattcactcaaagaagagtattgtctcaaattcaatactcttcttttttgtccaaaaatcgtcaaatttcgttgatttattttgctaatccgataaaactatgctatgataggactattggcaaaaacgtccgattttcccgtttttgttcatcagacagcctagtcctgtatcaatgatatttcattaaataacttgtgtaaatttccatctgctacgttgtcgtcaatcgccgtagccactacggctcattcctctgtcttgcagattgaaaatttatcctgcgttatttgtttaaaagtcaatgatacagtacactaaattttactcaaaggaggattttttcatggaaaaaatatggattgccggtgcaaaaggacacgttggctctgccttgtgcgatttacttgactgcagacattatgaaattctgccaacggatttagaggaagttgatatcacggaccgtgaatcagtcagcaattatgttcgtgtcagccgtcccgatgttttgattaactgtgttggttttggtgatattgcttcttgtgaagcccagccggataaggcatatcaggttaataccgtgggtgcacgaaatcttgccgtacaggcgcaggctatcggtgcaaagctgattcatctgtctaccgatgacgttttctctcatcatgccagacagccttataatgaatttgaaattccaaccccttccaccatttatggaaaaagtaaacttgcaggagagcgttttgtacaaaatctctgtacccgccatgttatcgtaagaagcagctgggtctacggtattggaagagattttgtaaatacgattctagaagccgcaaataatccttctgtcacttctatggaagttgcagaaaacgaatttgcaagccctacaagtgcaaccgaacttgcaaaagtgattgaacaactgattgataatgactgtcttggtatttatcatgcagtctgcggcggattttgcagccgatttgaatttgcacaagcgattttaaaggctattcacgcaaaggataagctgactttaaaaccgatttctgattcagaaactatcaattattctgttcttgataatatgatgcttcggcttgaaaattttactcagccgatatcctggcagcaggcattaaaagactacataagaactacaggaggaaataactaatgccaaaaaccaaaaacaccaaaaagaaactcagcctgtccactctgatttttacagctctgcttttgggtgctcttttcggagtcggacttcattatctcattcctaccggacatatccgtgatgatatcataatcgaaggcatgctttatgttgtcggtcagggatttatccgtctgatgcagatgctcgttgttccacttgttttttgttctctagtatgtggaagtatggcgattggagatacaaaaacacttggaaaagtggggatcaaaaccgtactgttttacttatttaccaccgcaatggccgttaccgttgcactgagtgttgcttctctcattaatccgggacttggcgtcaaagtagacaacatctctacttctgaagtttccctttccgaaagtaaaccactgacagagattcttttaaatattattccaaaaaatccaattgaatccttagcaactgccgatatgcttccaattatcgtctttgctttatttgtcggtatcatgttagcaaaacttggttctaaaacatctaccatagccaattttttcagccagttcaatgacattatgatggaaatgactatggttgttatgagtgttgctcctatcggtgttttctgcctgattgcacgtacgtttgcaaatatcggattcagtgcctttgttccaatgttaaaatacatgggcgctgttattcttgcacttgctattcagtgttttggtgtttatcagattttattgttcttatttacacgacttaatccgatgcgctttattaaaaagtttttccctgttatgagctttgcatttaccactgctacttcaaatgcaacaattcctctttccattgacactctgcacaagaaaatcggtgtcagcaagaaaatctcttctttcacgattccactgggtgctaccgtaaacatggatggaacttctatcatgcaaggagttgctgttatttttattgcacaggtgtatggaatttctttaactccttctgatttactgaccgttgttgcaacagctacacttgcttcaattggaactgcaggtgttccgtctgtcggacttgtcactctggctatggtcttacaaagcgttggacttccaaccgagggaattgccttgattatgggtatcgaccgtattcttgatatgctccgtactgctgttaatattacaggtgatgcggtctgcactacaattgttgcacatcaggaaaaagctcttgaccgtactgtctttaacgaaaattaaatattccagttcaaacaaaaatacaggctccgcatcagcggtcagcctgtatttttctaatatctgaaaatcctgtattttgctgaacgatttccacatcaagaccttcatctgcaaaatagcctttttcctgttaatcgacgcctgaatctttatgctccctccgccggtgttatccggttcaggtctaagggtctaaaatgacttccctgttctattctcaaccggattccaccaattcccctgttattccttttcaagcctaatctactctatacctacagtcaatactcttttttccatatcctgctaagaatctgcaaagcttctttgatttcttcttctgtaagcgttgcatatccaattaacacaactgcttctgtttcttttttttcctgtacaaaaaattcagataaaccatagacacgaatgcctgctgattttgcgcgctccactgcctcatcttccgaaatcccattatgaaagcgcagcaacagatgtattcctgcatgttctccaaaacaactgcagatttcgctcatctcttctttcacccagcgaagaatccagtcatgtttacttttataaagacgtctcatccgatttaaatgccgttcgtaatgtccgtttcttaaaaacagctctactattttctgatctacttttgaaatggttactgcaaacggatatctgctctgatagtatcgcatcaatttttttggaagtgccatataactgattcgtatcgatggtgcaatggattttgaaaatgttccaatataaatgactctttcgtttttatcaaatccctgcaatgccggtattggtttgcctttatatcgaaattcactgtcataatcatcttcgataatataagtctgattctcatctgcccagcgaagcagttccatccgacgtttcaggggcattactgtccccattgggaattgatgtgaaggcatcacataaaccacgtcagcacctgtcttttcaagttcttcgatacagattccatctcatcgctctttactgtacacactgaacagcctgtatgtttcaaatcataccaggcacttaaatacgttggattttccattgctacttttttattacattcaaaaagggtagccaaaaccataagcagataatcatttcctgctccaactaaaatctgactcttttcacactttactcctctggcatgatacaggtactctgcaatagcttctctgaaagaatcttctccatagggatttccctgtgcaaaaatttcttctgtagaatcacttaacacctgttttgccagctgtttccaggtatgagttggaaaactttccggtgcaattccatttagtgcaaaatcgtaacgatatttctgtaattttcttctctgttttatctctgtcttttctggattgttttgtttcgtatactctgctttttgaaaataaatcccttctatttcgcaaacataatatcccttataagcaaccggttcaatataaccttccgcaactaactgatcataagcagtttcaatggtacttcggctgactagaagatttgctgaaagcgcacgggaggacggcaaccgcatccctgcgacaagccgtccttcctgaatttcctgtttcaaatattcttcgatttgctgatacaaaggagtgaggctttttgtatcaagcggaatcattaattcattcatagcagtttttcttatttcttttctaatttgaaagaactcttaagtgaaacaatacggttaaatactaacgcatccggtctgctgtcatggcagtctgtacagaagaaaccatttcttacaaactgatagctgtcaaatgcctgagactttttaagttccggctctacataagcctttacaacggtcagggaatttggatttacattcaaacttccgtcttctttattataaacgcctttttcttcgtctacaatattttcatacagacgacattctgtttccactgcggtctttgccgcaacccagtgaatggttccttttacttttcttccgtccggagagtttccacccttagaagcagggtcataagtacaatgaacgactgtcacattcccattttcatctttttcaacatctgtgcaggttacaaaataagcattcatcagacgtacttcatttcccggatacagacgtttgtattttttaaccggtacttccatgaaatcttcctgctcgatgtataattcttttccaaatggtacgcttctgcttccaagttctggattttccatgttatttggagcttctaagtattcaatctgctcttccgggtaattgtcaattacaagttttaatggatttaaaacagccatcacacgtggacgtttcattttcaaatcctcacggatacagtattctaacattgcataatctacagaactgtttgcttttgaaacgccacagagttctacaaattttttaatagattccggtgtaaatccacgtcttctaagtgctgcaatagaaaccagacgcgggtcatcccatccatctacaattccatcttctactaattttttaatgtaacgttttccggttacaacatttgttaaatataattttgcaaattcaatctgttttggcggatgtggatattctaattctgtaactacccagtcataaagcggtctatggtcttcaaactccagtgtacagatagaatgtgtcaccccttcaatggcatcttcaatcggatgtgcaaaatcatacattggataaatgcaccatttatctcctgttctgtgatgattcatgtgtgcaacacgatagatgaccgggtctctcatgttaatattcggagatgccatatcaattttcgcacgcagtactttagaaccgtcttcaaattctccatttttcatgcgttcaaataaatctaagttttcttccacactacgatttctgtatggactttcttttcccggttctgttaaggttcctctgtattcacggatttcttcagcagataaatcacagacaaaggcctttccttttttaattaatttaattgcggcttcatacatctggtcaaaataatcagaagcaaagtataaacggtcttcccagtctgctcctaaccattcaatatcttttttaatagactcaacaaattctactttttcttttgtcggattggtatcgtcaaaacgcatgttaaattttccatggtatttctgagccagtccatagtttagaagaattgactttgcatgtccgatgtgaaggtatccgtttggttccggtgggaaacgggtacaaatttcatcgtatacaccttctgctaaatctttttctataatctgttcaataaagttttttccaactgtttcttctttgttttcttctctgctttcgatttctttttccactctttattcctccagtctctttggtctatgaattatactaccataaaaacggtatttttcaaaggttttctgtatattttttatttttccggtatcagcataaagtttaccatcgcagttgccaaaagctttccgcttttttctgaataacactctgtatgaatatttgccagatgctttccaaccctgtctgctttcgccctcactaaaagtgcatctgctttttctcctgggcgcagataattaatgttcatattcgtagtcggcgtgatatgacatttgcttaaactgcgtaccaatgcaccacttgtcgtatcaattgctgctgcaatcagacctccatgcatcgtaaacatgtggtttaattcccaatcctgtatcggccagcgaaaagtcagttcttttttttcaaaatcacacgaataaaactccagtgccatttttcggtacaaatgatccggatcacttggatacatttttttgatgctttctcttacttcctcttccatttctatttgttcctgcaagatatttgacattgttttcctcttttctgttctttctttttccgatttattttcaataacgaacttctgatagagtaagacctcttgccggtacggtaaatcctgcactactgcgctccttagcttctaaaatcccatcaattgattctgccattttctcgcctctcccaacttcaatcaatgtaccggttaaaattcttaccatattgtaaagaaatccatttccccgataagtaatccggatttctccattttcctcttctaatttaatttcataaattgtacggacagttgattttttcatttttttattcgaacaaaagctcttaaaatcatgcgttccgacaagtttttctgctgcttttttcattgcttttatatccagcgtttcctgcaatggataaacgtatttccgctcaaatacatttttgtgcccacctgttaaaattcggtactgataaatcttttcttttgctaaaagtcggctgtgaaaccgtggttctgcctcactgacacactgaactgcaatatcttccggcaaataatgatttaagtactcacagatttcctcgcagcttttttctgtttccagatggacatttgctacctgcccctttgcatgaactcctgcgtcggtacgaccagcaccatcaatttcgattggggtttcacacattttcgagagcacttcttctattttcccctgtatggtgttagttgtccgattctgcctctgccagccctcataacgacttccgtcatattctatatccagcctgtaattcatactttttgattctgccctttctctgtttttcttcatatcattatatcaagttctgatatgcgggtcaaatctgcaaatcaagactggttttctcattcttattatgttattcttcttccaaacggatctgtgcaatctgctatattcacttgcttgattcggtaaatatgtacccttgagtacacaactatttttgggagaagaggcgctgcttctattgtattcgcaatcatggcgacggttgatgatgcctataccagtatagatctgtttcatatattttggataaagatttgcttgtgatttattcttctgacaaatacaaacctgatttttcttcttaaaccctgtctgatttcttttcttattttttgggatactgtacttctcttctaagtaaaaacaacgccagcagattgggaattgccataagaccatttaaggtatccgacaattcccaaatcatggcaggtgcaagcatacacccaagaaatgccactgctacatagagccatttataaatttttgttcctttttcttttgcaagataaaccgcagtccgctctccaagacacgaccatccaatcatcgttgcaagggcaaaaagtagcgtagataatacaagcagttcctctccaaacggaatcacacttccaaatgccctcgccattaaagtcgttccatctatattttcaattccagttgaaaagttttgaatgcagatttccggacgatacacaccactgactaaaagcacaagtgctgtcaccgtacagaccagaatcgtatcgacaaatatttctgcaattccccacattccctgaatttccggcttctctacatcagactgcgcatgggcaatcaccgaagaacccagccctgcctcattggaaaatacccctcttgaaattcctgtttgaatgattgtttttaactgatatccgccaacccctgcacacgctgctcttggagtaaatgcattttttataatttcccaaaatgcccatccaactctgtgccgacaggcaatcaaaatgccacacgctgttatcagataaattcctgccataaaaggaactaatttttctgtacagactgcaatccgcttcattcctccatttaaaatataagcaaccgctactgctgatgcaaccgctgtaaaaaacacaggaatctgaaatacgtttttcaagccatttgccatggaatttccctgcaccatatttcccattccaaaagatgctccaatgcagcaaaaagaaaagactactgcaagccatttacagccaagtcccttttctatatagaccatcgcacctccgacccactgacccttttcatctttataacgataggtgattcccagatagttttccgcataattggtcatcattcccaaaactgcagaaatccacatccaaaagatagagcctggacctcctgccattatcgcggttgcaacccctgtgatatttcctgtaccaagcgttgctgccagtgccgtacaaaaagactgaaactgcgaaaccgcctgtgtttcttttgtatttcttatttgtggatttttaaaaagtgaacccagagtctgtccaaaccattgttttatccttaaaatcgaataaaattttgactggacagtaaaataaatgcctgtcaataaaaaaaatgccaacattcccggactccagacaaactcatgaagggtatgtaagatttgttccatctcttactgctctcttatttcgctctatttaaagcagtatatgaaaaaactgccttggttatcccaaggcagtccattttgttactggatttattcaatttcaagcaaagcttttttaattattcaaaagcttttccaacagaaccaaacagttccattttttctttgattgtatcacagattgcttcaaagcctggttttaagagtttacgagggtcatatccttttccttcgttgtcttttcctgcttcgatgtattcacgtgtagctgctgcgaatgataactggcattctgtatttacattgattttagatacacctaaatcaattgcttttttaatcatgtcagccggaattcctgtaccaccgtgaagtactaatggcatttcacctgtgagtttctgaatgtcatccaggacatcaaaacgaaggccttcccagtttgccggatattttccgtgaatgttaccgatacctgctgctaacatatctacacccaggtctgcaatcattttacattctttcgggtctgcacattcaccctgtccgattacaccgtcttcttctccaccgatagaaccaacttctgcttcaagggataatcctaatcctttgcaaacacctgctaattctcttgttttttcaacattttcttcgattggataatgagaaccatcgaacataatagatgagaaaccagctttgatacatttgtagcatccttcataagtaccatgatccagatgcagagctacaggaactgttatattgagttcttccatcattgcttttaccatagctgcaacagtcttaaatcctgtcatgtatttacctgcaccttcggaaacacctaagatgattggggatttgcattcttctgctgttaacagagctgcttttgtccactccaggttattgatgttgaactgtcctactgcataatgtcctgcttttgctttttttaacatttctgctgctgatactaacatatttctgacctccatttggtaaattaccgtcgtttttgttctaagaaaaatgcaaaacaacgtttgttattattataacacatttcccttttctggcaagtatttttaaataaagttaaaagatttcctattttctggacacaaattttgcaagcccatctgttcctaccggcacttctacctgtccctgaaccagcggaagtgcatagaaaataaactcttctccaatatcagagccctcatttgtaatccaggaaagaggaactgttttttctttattacaaatttcattgacatcttctaatccaagtttcatggcataaggcaggttactgattctgatataagaaaccatttttccggtttcaccttttaatgccaaacgcacaccaaactctccggcagataccgcttccttctggtccgtttttgacatcatagaagaagaacatctctgtgaaacatttaattcaacggaacgtgcttttacaccaagacggtttctgactaaattttccagatatttgccacatcctgcaagcatcttatgtccaaaggtatctgttccaactgcattatcatactcacagataaagacgccatctttatcatgaattccttctgaaacacaaacaactacattgagatttttttcaaaacaagcttctactttttttaagaaagcttcttcgtcaaacgcagtttccggaagataaatcaaaagcggattatctccgacactctttcttgcaagcacagatgctgcagtcagccatcctgcatgtcgtcccataatttcgataatggtaacggatttcttttcatagacatttgcatccaacacaatttcacgaacggtagttgccacatattttgcagcacttccaaatcccggagtatggtctgtcagcactaaatcattatcaattgtttttggctcaccaatcacacggatatcacttcccactttttttgcatatcgagaaagtttacttactgtatccatagaatcatttccaccgatgtagaagaaataaccaatttctaactcttcaaatttttgaaataatttcggatataccgcatcttccaaatcttccggaagcttatatctgcaagaacccagatatgctccgggtgttgtctttagatattctaactcttctcccggaagtgcttcttcaaaatccagtacagttccatttaaaaatccttcaattccatttaccattccatatacgtgtgcaattttttctttctggcgaagtccttcttttaccactccataaagactgctgttaattgccgcagttggtcctcctgactgtcctacaatcagattttttcttgtctggctcataaaaatactcctttctgataccttctttatcagaatatcatacaagcaattttcacacaagcgttacagcaggtttttttccaagaatggaaagcaggtttgcacaagtaaattcccgcatactttcttttgatttttctgagacatgttcaaactgggccagatacacaaagtaaccaaataatgctggaaatgcaactgcctgaatctgaaaatctgaaaactctggatgaatactgttttcttctcgcccctgttttgcaattaattcaagcaccgtctgtgcgtattctctcgcagatttcattttttcctcaatttctttttgtgccttttcttctgactggggcagtttaaataactgccggcaaccattgtctttatataccacgttttcaataaaattaaatacctccatcagctggtcttttaaacttttttgtctctttaagttttctaccagttctaaaaatctctgatttccatgccagtatattgcctttgcaatcatttcttctttactcgaaaaatattcataagcagttccttttccaacacctgcacggtttgtaatatctgaaacttttatctgatgaacttccattccctcatctaacagttctattaccgcctgatatagaagaagttctttttcactcaaagttcgcttctccatctgctaatctctcctcatctttcttataattgcgacggtttaagatatcatacacacaaggcacaacaaacagtgtaagcagtgttccataaatcaatccgccaatcgtaacaattgccatcggctgcatcatatcagagcccataccaacacccattgccattgtaacaagaccaagaatcgttgtaagagctgtcatgataatcggacgcagtctggaacgccctgcctctgcaattgcttttcgtttttccattccttcttttcgaagctgattaatataatcaaccaatacgataccgttattaacaataataccagaaagcatgacaaatccaatcattgcaaccacactaatcggcttattggtcaaaatcaatccgataaatccaccggtaaatgcaagcggaatcgtaaacatgataataaacggagataagacagactgaaactgcgccaccatgattaaatacataaataccagcgcaagtgcaagcattaacattaactgactcatcgcattattaattgtctcatcttcacctgtcatttccacagtatatccatctggaagctcgtatttgtctaatactcgctggacatcctgactgacaagcccaatgttataaccggtcgcaatttccgcactcacagacatataacggctttgggcatctcgtgtaattgtctgtgggctctgggcatcttcaaacgttgcaatatctccaacttttatttcttttgtttctcctgacgcatctgttgtctcaattgtaatctccgaaagtgcttctcttgtcaaatcctcatctgcttcacttgtcacatacacatcataatctttcgtcgctgttgaaattgtggtagcagaacttgcttctgcaaggcgtgcattaatcttctggaatacctgtgcaacggtcagattattgcgcattgcttttgctttatctacgataattttatactgcggatcagaatcctgaagcccatcagaaacattctgtgttccctttactttttctacctgtcttgcaaggtctgctgagatttcctgtaaagtatccaactcttttcctttaattcggatattaattccactgcttccaagcgcactcatatccatagaggaagtggaaatgttaatctcgcagtcttcgattcccttcgtgcgcttcttaatctctttttcaagtccggcactggatagttttctatcttcttttaataccagatacatcgtcacctgattggtcgaggaacttccagataatgatattgaagaaccacctgccatagctccaatggtttcaatatcttcgatatcttcaatcttctgaatcacttcatctgatttttcagcagtttcttcaagcggagttccactatctgttgttacggtcagtgttgcctgtgtactttccatgtcagggaaaaattcagttcctttctgaatcgataagtacatgcttccaaaaaataatacaagtgcagcaattaacacccaaactttatgttttaatgcttttaaaaccagtttttcatataaatcctgaatctttccaatggatttgacctgttttgcctctccctttctcaaaattccggctgacatcattggaactaacgtcaatgctacaatcaaacttgcaagcagggaatacgcaattgtcagtcccatatctacaaataactgtcttgtaattccttcggtaaatacaattggtgcaaaaacacataccgttgtcaaagtagacgctgcaatcgctcctgctacttgagaagccccttcgatggctgcttttcttgcgggtactccaagtgctctcattcggtaaatattttcaatcactacaatcgagttatccacaagcataccaactccaagcgcaagccccgacaaggaaataatatttaatgtcactcccgaaaaatacatcataacaattgcagctacaacactaatcggaatggaacatgcaattacaaaagtcggcttgatatcacgaagaaataaaaacagaattaagattgccaaaattccgccgtaaatcatgttttccattacggaatttacaactaaatcaatataaattccctgattcatcaatgtcgtaaaatgcagaccatcattggaagcttctaattcttccattcgatttaaaattttatctgtgacatctccagtggaatatcccgtctgtttttcaatcgaaagcatgacacctggattgccattgatttttgcatacacttcagaagaatcatcttccacattaatatctgccacatcagaaagtgtaatggatttcagaccatcaatccccaaatccatgataaccaaatctccaagagaatctacgtcctgaagtttgtcgcctacacgtatcagataatcacttccatcttctgtcacataacctgccggcatcgaaaaattctctgctgttaagattccttttatcatatcagaggttaaaatctgattcaaatcggatttttcctgcgcctgttctttcgcttcagaaagttgttcttttccagaatcaagctgagcctgcgctgtttcaagttgaacagaacccatctcaattttatttgcagcagtacttaactgtaccgaacctaaaattttctgtgcctcaagttcaatctgcgcagaagtcatctgagattttcccgcttcaatctgttccttcgcacttgttagcatttcttttccggcatctaactgttcctgaccagaagccaactgtacctttgcttcggcaatttcttttaatccctgatttgccgcctcaattccagtatcaatactttccgattgaaggttttccatctgtgcatttaactgttctaactgagcagtcagctgctctttttgtgcctgtgcggtttctaagccattctgcacggtttcaatagacttcttccactgttcttcggtcatgccatccggctttttttctagtgcatctaactgcccctgcagattttctatctgcgcatcaatctttgaaatcgcatcttctaactgtgactgaccactttctgcttctgaaagctgtccctttgcctctgtcaactgctcaatcgtctgatttaataacgcttctgtcttttctaataactgtttctgtgtatcaagctctgcctgcttactttccagattttgaagctggacatccacttcagcagcattttttgtcaattcactttgcgcttcatttaattttgcgcttccctctccaatttgagaagctgcctcgttttgccctgcttctaattcctgctttccatcctcaagctttgctttattactgttcaattcttcctgtgcatccgctaaatcctgttctttttcttcaaactgtccattgattgcatcctgaactttttgatttacagcatctaacttttcctgactgatctgaacctgaatactctctgtgacatttccactgacactgattctggcaactccgtcaatactttctaactctgactgaacattgttttcgatataatctgttacctctgcggcagacattccgtccacatcagctgctgcaactaataccggcatcatatccggatttaatttcatgataatcggatttcctacggaatcgtcccaatatccttttatctggtctaaattttcccgcatctccaatgtcacggaatccatattggtggactccccaaattccagaattacaaccgatgcattttcacttgacattgaacttacatttttaatattgcttaccgttgccatactctgttcaatcggtttggtaacggtctgttctacggtttcaggacttgcccctgggtaggtagtcataacaattgcataaggcagatccatacttggcagtaagtccgtactcatctttgtaaatgagacaacaccaagaatgataaccagcacaactgcaactatcacagtatacggctttttcacactgaattttgatatcatagcctcctccatttcgctttcttttaagttgaatttttccgactgactggtcagtcagttgtgaaatcattataaaactgaataaattctttgtcaataaaagaacttgcttcgtaaaataaaaggcagcaggaaattcgactgttctctcatttcctgctgctctcattatcctattttcagtaaagctgtggaatgcttatctgaattcagattttcttacttctgtgcttctattttctccgctaaatcatttaaatacacccagcgatccattttttcttctaactcctgttctgcttcctctttttctttcattaattctgaaagcttcatggaatttgttgcattttttaccatctcagcatccaaaaattctatttttccctctaattctgcaatgtcatcatctattgtctcaatttctctttgctctttataagaaaattttaatttctgtggacgattctgtttccagtttttttgtgccgtttctttcttttctttcttctctgattttagaagcccatctacactacttcccattctctccagttttgcttcaacataatccgtatatccaccttcatactgctgcaagtgaccacaaccatccaattcaaaaattcgatccactacattatccaaaaaataacggtcatgggacaccgtaattacaatcccagaaaaagagttcagataatcctctaaaattgtcaacgtcggaatatccatatcattagaaatctcatccaaaaccaggcagtttggagcagaaatcaatacacttaacaagtacagccttttttgctctccgccggaaagtttggatactggtgcatactgcatatcaggagtaaataaaaaccgctctaacatctgtgacgctgtaatccttccatcacgggtcggaacatactctgcaatatctttgatataatcaatcactctctgattggtattcatatccggtacttcctgcgcaaagtatccgattttcacagtctctccaacctcaatctgaccagaatccggctctacaagccctgcaatcatttttaaaatggttgattttccgcagccatttggtccgacaaatgcaagtctttgatttcgaagcacaatataatcaaaatcctccaccagatttttttctccatacctcttactgatatgatgaagctccaccgtcttctttcccattctcgtctctacagaatcaagttctaatgcctgttcctgaaccggtgcttttccattttttaatgcttccagacgctctaatcttgctctctgctttgtacttctggcacgacaaccacgttttgcccattccagttccattcgaagcacgctctggcgtttccgctcggatgcaagttccatctcttctctttgcgcttttaattcgagaaatccagaataattggattcataactatataaattcccacgagaaatttcaagaatcttattcgtcactttatctaagaaataacggtcatgcgttaccataattactacacctttatagctctttagataatcctccagccatacaagcataccactatctaaatggttcgtcggctcgtccaataataaaatatcaaacgaccctgtcaatacttttgcaagcgcaacttttttcttttgtccaccggaaagctcactcaccctctgttcatggtttgtaattccaagctgatttaaagcactttttacctcactttgcgccgtccagtctgtctcatctattccatccatcgcataagacaaaaccgttgcatgttccaaaaaacatggattctgtgacagatacgcaagacgaattccattttgcataataatctgcccttcatccacctcttccactccggcaattatattgagcatcgttgttttccccgttccatttaaaccaacgattccaatcttatccccttcctgtactccataagagacatcatcaaaaatctttttatctccaaatattttgctgacatgttcaatatttaatatgttcatttttgctttcttccctttgccttctttctttaaatgacatagtttcctacatcttcactatttccaattaaatcctgcaaagaaattttatcaaaatagtcctgaaccaacttatgaaagtctttccacatttttaatgttttgcacgtatctacacgctcacaggtatttacttctccttctaagcaggcaaccggtgcaagggaaccttctgtcacttttaaaatacttccaatcgaataatctgccggcgcttttatcagtttatagccaccgccctttcctctctgggcgcgcacaaatccatttttactaagagctgccacaatcgcctccagatatttttccgaaatttcctgtctctttgcaatatccataagtggaatatattctcctgtgttatgttctgccaaatccagcattacccgaattgcataacgtcctcttgttgatattttcatctataactacctccatcttttaacaatgcagtatccaaaaatttctaaactgcatccttccatccatatttcctattttaccatggtcttactatgtattcaaggcaagaaagcgacacaagctacgagatttggaaacaaaaaccgaagagttctcttaaaagaaaactctccggtgctctttttaaatataatacatttcctgcctgtcatagtgctcagaataatacaagaccagttgtgagattgtcagattttccagtatctcatccagttcatgattcactttgtcaatcacaagacgctgaatcgtatctgcaattcccacgtactcactgtttggctgggctacctggttatctaagtgatatgttccttccaaaacctgtaagacatctgccactgtaacttcagctgcactttttgccaactgataacctccctgtggaccttttacgctccgcacaagtctggcacttcgaaaggcagcaaaaatctgttctaaaaactgttgtgaaattccatttctcttcgcaatatttcccagagaaactggtccattttgggaattcactgccaaatcaatcaacgaaattaaaccatatctggtctttttagaaaagctcattcttagtcctgtacggctttgaatgcttcatccaaatcctggataatatcgtcgatgttttctgtaccaatggataaacgaattgtatttggcttaattccctggtctaacagttcttcttctgtgcactggctgtgtgttgttgttgctggatggataaccagagattttacgtcagcaacgtttgccagtaaggagaataattccagattatcaataaagtcttttgccttttgagcatctcctttaatttcaaatgtaaagatagaaccaccgccattcgggaagtattttgcgtacagttctttctgtgttgcatcatcagataccgatggatgatgtactttttctacctgtggatgattatttaagtattctactatttttaatgcattttctacgtgacgttctactctaagagataatgtttcaagtccctgaaggaaaataaatgagtggaacggagaaattgttgcccctgtatcacgaagtaagattgcacggatttttgtaacgaaagctgccggtcctactgcttttgtaaagctgattccatgataacttgggtttggctctgttaaagatgggaattttcctgaaccttcccagtcaaatttaccactgtctacgatgacaccaccgattgttgtaccatgtccaccgataaatttcgtagcagaatgtacaacgatatctgcaccgtattcgattggtcttacaagatatggagttgcaaatgtattatctacaacaagcggaattttatgtttgtgtgcaatatttgccagagcttcaatgtcaacaacatccgagttcgggtttccaagtgtttcaatataaattgcttttgtgttttcctgaattgcagcttctacttcatcatagttaaaaatatctacaaatgttgttgttacaccgtactgtggcagagtatgcagtaacaggttgaaagaaccaccataaatattttttgctgatacaatatggtcaccattctgtgcaaggttttcaattgtatatgtgatagcagctgctccggatgcgactgctaatgctgccacaccaccttccagtgctgccattctctgttcaaatacatcttctgtcgggtttgttaaacgtccatagatgttacctgcatcggcaagaccaaatcttgctgctgcatggtcgcagttgcggaatacataagatgatgtctgataaatcggaactgctcttgcatctgtcaccgggtctggtttttcctgacctacgtgaagctgtaatgtttcaaatttgaattttctattttctcttgtaattttttcactcatagtttaatatcctcttcttctcttttttatttaaattattctgtgaacagtggtgtagagtaatatctgtctgctgtatccggtaacaatgctacgattgtttttcctttattctccggacgctgtgccagttcaattgctgcgtgcagtgctgcacccgaagaaattcctactaaaactccttctttcttagcaagcagttttcctgtcttaaatgcatcgtcattttcaattttgataatttcatcatagatatcagtatttaatacttttggtacaaatcctgcaccgattccctgaatcttatgaggaccaccttttccttctgaaaggactggagagcttgccggttcaactgctacgattttcacatccggattctgagattttaagtattcacctgttcctgtcagtgttccacctgtaccgacacctgctacaaagaagtccacttttccgtctgtatctttccagatttcaggaccggttgtttctctgtgtgttttcggatttgccgggtttacaaactgtccaggaatgaagctgttcggaatttcttttgcaagctcatctgcttttgcgattgcacctttcataccctgagcgccttctgtcagtaccagttctgcaccataagcttttaagatgtttcttctttcaacactcatggtttccggcatggttaagataatacggtaacctttcgctgctgcgattgctgcaagaccgattccggtatttcctgatgtcggctcaatgataacagaaccttcttttaatattcctttttcttcagcatcttcaatcattgcttttgcaattctgtcttttacacttcctgccggattaaaatattccattttaccaagaatggttgcttccagacctaatgcattttcaatgtttacaaattctacaagtggcgtatttccaattaatcctaatgttcctttataaatgtttgacataactctttccgcctttccataacaattctttttatttttttatcgctaagcttaactccctttaacatactcttttaatatgttttctatgttttacatcatatacctctttttttgatttgtcaacacttatctttcatttttttagtcaagcggatattcgcaatccactttcgctacttgctcataaccaaatagctgctacgcagcttatcagaaggggcttgccccctcctgatacaagcaagtccccacccctgcttattgctttttgcaattgaagcaggggacttccttgatttggttaaaaacatagtaaacttatcagcaaactaaaagagtccttaaaaatcagctttttttgctgatttttaaagactctcaacttagattaacttattaagactgcgcttttaaaaatgcttcgatttcactttgttttgctttcacagacccctgaaccattggaggtcttcctccaccccttccatttaaggtctgattcatttcttttgaaatattcgtaatctctttctttgaagaaccaagaatataacgatacccctccgcatctgtcccaataaatgctccgcagattccatctgttattctcattacatcattgacgaaatttcttactgccacggtatctaatgtttcttcgaataagagcacgcaggtatcctccggctttatctcttttaatactccttttaagtactgttcctgcaaaatccgaattttttctttctgtgcctccacttctttttgcagacgctctactgcttccgcaacggaatccggttttgcagaaagttttcttgaaattgttacgacacttgcttctttttgattataatccaaaagcgcacggaaaccgcagaccatcgaaactctcattccacccttgtatttaattgcaccgattaatttaattaagccaatctgaccggtagcatctacgtgcggtgcacagcaggcacagctgtcccagcccggaatcactacgatacgaacctgtccttcgatttctattttgcttctgtaagtcatcgtttcaagttcttcttttgtcggatacaacacttgaatttttacattatcggcaactgcttgatttgcttcccattctatctcttttaaatcagtttctgtaagcatgccgtcaaaatccatcgttacctcttcatttccaagatgaaatcctacattgttgtagccaaaacgacggttcacgattccagatacaatatgctctccggtatgctgctgcattttggaaaatcgttctttataatttaatcttcctgtaactttgcttccctgctcaattgcgtctgttacataatgggttacaatctcatttttttcctgtacatcaacgacttttacttctttttctcccacaagaaggactccggtatctgcatactgaccgcctccttccggaaaaaatgctgtttgatccagtatgacttcaaacataccgtcttttccctgcatacaactttcaactgttgctgtaaattctttgatactgctatcctgataaaataatttttctgtcattttactaaaatcctttagtccccgtatacacgaattacttttgaaactttctgcacaacactcatgccttcaataatcatcatggcatcattgaagtttccttcttttacttttgaagttacaacaacaagttctgctaattcgccctctttgtttttctggataacctgagcaatacttacattattatttccaaatacacttgcaatacttgcgagtgtaccggcacaatccgatacatgcattcttaaaaagaaacggctttccatctcatctgcctttttcagaggaagctgtttatagcaggtgcagccaattcgtcccgtacattcaaatacaatatttcttgctacatcaaaaacatcccctgcaattgcactggctgtcggcaattcgcctgctcctcttccatagaacatcgcatcacctacggcatctccggttaaaaagactgcattaaaagaatcatttactgtcgcaagagcatgcgtctccggaatcagcattggacgtacgctgacttcaattccgttttctgtatttcttgccacacctaataacttaatcacacagcctaattcttttgcataacggatatcttttgcggaaatctgtgtaatcccctctgtaataacatcgtcaaatgtgactcttgaattaaatgcaattgatgccataattgccatttttcttccggcatctaatccctgaatatctgcagtcgggtcagcttctgcatagccaagctcggttgcaagggcaagtgcctgtgcaaactccattccctcctgagtcattttcgttaagataaagtttgttgtaccatttacgattcccatgatttccgtaatatgatttgcagccagacactgctttaatggacggataatcggaataccgcctgcaactgcggcttcaaataagaaatcacagttatgctctgcggcacactccaataattcctgtccatgagaagctactaaatccttatttgcagttacaacatgttttcccgcatttaatgcctctaaaatataagttcttgccggctcgattccgcccataacttcaattacaatttcaatggattcatcttctaaaattgttttccagtcatttgtcagaatttccggattttctaccttagcagatgctttctttaagttgcgcaccagaattttctcaacttctacaactgcaccgattttatgcggcatttcctctttctgatttcttaaaactttataaactccacttcctactgttccaagaccaagcagtgctgcttttattactttctcgctcacaatttatcctctttctttatcactttatttgttctctctttacgaatcggattttgcacatgttctacaaatccttttttcatttttgtatttcgctgaaacgctttgcttaaaccacccaacttattatatacccagaaagaatgtactaaaaccgtatttacctttccgattttctctttcgtcgttccggtatagtttgttccgccacattcaaattttgtacccttcatgatttctgtgattaaatcagattcacaggtaatatcatccggtatttctgtataggcaagtcccacacaatcctgtctgtgcgcatcacttccacctgttccggtcaacccatacttatctgcaattttctgagcttttccatttacttcctgtgattcacatgcattaaaagtttccatgaaatcaaattcctttaaaatctccggatttctctgataagcctttgcattcataaaactcatatatttttccccacatggatgcgccggtcctaagattccgccataattatgcacaatcggaattaacatctgaatcggcattccacgaagctccaaaagccgaagcttaatggtctccggcataataacaataatgtgtcctgcatctaacgtatcatactcaattccttttaataccagaaaatcttcatgctttttacctttaataaattttttccagtgccggtaaccacgataagaatcatggtctgtaaccagcattcccccaaatccattttgttttaacagggtaatatactcatcaattggaactttcccatcgatagaaccctcttttgtgtgacagtgcatgtctattttcataacaaacaacacctcctccgatttacctacacaatctcttttgtatctttctcttattctgcactcattccaaaacgtgccagtaaattatcaaaatgctgaagctgaacaaccagattgaatccataaggattaattaccataccaagtgcttccggcataataatttttttaatatttttaaaatcaatcatcattgcacgatatttgccttcacgatttaattttgaaaattcaacggtatcagtaaaaatcggaagcataaatttgtcttctttactttttaaatagaacacctttaatgcttcttttttctgttcttcttctgttttcccttcctgaggtttttcgactgcaatcataaatttactttttaccagattggcagccatctcttcttccagttctttaatattctctttttcttccattggaacttctcttcttaattcctgcataaaataagttcctgtaatctgcagtgccggattctcaagtggtctcttatcctctggaattttttctaatattggacgtttgacaatctctgtcagctcaaattctgttgtctgttctttttctacaaataccaccgcattgacgccaagcgtaaataaactggtaaaaaatggaagatatcctttattttcgatttttgccggaattaatttatgtttctgctctatcatataaggctttgcagcctctttcatatcatcctcgacttcaaatatccaaacctggtcattaaagttctccttatcacaaactacaaacgggttatgcgttcccgcattgataagcagatagaactgctccattttctgcagtttctgcaggctttcgattttgcttttttccatgtcttaagtctcctgttgtatttttcatttatcctttttcttttagtatacacccaaccatgaattttgtcgttatttttttataaatataaatgaaaaagaaccaaacagaccattttcgtccatttggttctcctctgttcttatttatttacatacttcttcgtaaagatttctgcccttagaatcaattactacgataaccggaagattttctacttcaagtttacggattgcttctgttccaaggtcatcataagcaataacttctgcttttttaatacattttgaaagcagagctcctgcaccgccaactgcggcaaaaaataccgcaccatttcttacgattgcatccgttacttcttttttacgttttccttttccaatcattccggttaaacctaaatctaataaacgtggtgcatatttatccatacggcttgcagttgtaggacctgccgaaccaattggacgtccttctcttgccggtgtcggtcccatataataaatcacatttccttctaattcaattggaagtttttctcctctgtcaagtgcctggtccatgcgaagatgcgctgcatctcttgccgtatataccgttcctgtaatatatacataatcccctgcttctaaagtttttacttcttctctgtcgagaggtgctttgatatgtctatccataattcttctattcctccgtattagatttctcttacaatatgacggtttacatgacagcagatattaattgctaccggaagtcctgcaatgtgagttgcataagtattgatgttgactgcaagtgctgttgtatctccaccaagacctgccggtccaagaccaatctgattgattttctcaagcagttcttcttcgagtgcttttacgtgaggaagttcagaatgaacaccgatttctcttgtcagtgctttctttgcaagaattgctgctttctcaaatgttccaccaattccaacaccaacaacaaccggaggacaagcgttcggacctgcttcttttacagcaccgataattgcttcttttactccttcaattccatctgccggttttaacatgatgattttactcatgttttcacttccaaatccttttggagcaactgtaatttctactttgtctccaggaacgagttcataatggataattgcaggagtattatcttttgtatttacacgctcaagaggatctcccactaccgattttcttaaatatccttctgtataaccctgtcgcactccttcattgactgcatcttccacgcttccaccttcaaaatgtacatcctgtccgatttttaaaaatacaactgccattccagtatcctgacaaatcggaatcatatcttttcctgcaatatcaagattttccaataactgacctaaaatctgttttgcaagcggttttgtttctttttcatatgcatttttcattgcctgtgccatatccggtgccagatagtggtttgcctgaatgcacatttcttttatgtttgttgttaatgtctctacatttactgtacgcacgattcttttctcctctttcttttacttcaattgatttttcacttcaatacggttaaaatcttttaaactttctccctgatgtttacccatcagaccaatcaacatataataaccggttcttggatctaccggatactcttttacaagtgtaaaatcttcgattttgcctgtactgcttacatgcatacgcggtcctaaacattctaatatccagtctccgatttgtacatgcttttcgtcataataagaaaccgataaatcttttgccactgcttctcttactttctcttccaatttatacaaatctacatccggtttttcttcaaattccaacacgaatccatgacgaacatccgatcttggtccatcctgtgcatacccatctcccataaaatgaacacataaatcttccaacgtatgtgccatttttctgtattttacagatttatgtacaatgcctgctatattttccggtaatggaccaaacatgcttggtctggtaataataatttcttccccaattccaactaacaagtctgcatttctgtgaagcaaaggataaatcaaatcaaaatgctccacaatcaccatttttccattgtttgctgcctctaaaattgcctctgccagttcatgcatctgggtaaatgcagattcaaaccgaatgtccagatgataagtgtgcggtgcaaacgggtctgttaaatcttctgataaaagcggaagcggacgaatattgactccctcatcatcatttgtcaaatcgatcccaggaaacattcctttaattaaaagactttttcctgctcccgcatccccgataatcccaataatatgatcaaacggacttaaatacatctggcttagctggattcctaaatctgtcattcttctactgcctcttggcgcaaaataaaaactgtacagatttccttcctgcatttgttttgaatatgccatatcttttccctcttaataaaaatagccagaccgccccaaaacaaacgcttcaggacagtctggcatctttttttctttaagtctccactacttattgcttttcacaattgaagcaggggactttcctgattcgattaacttcttgctttacgaagcgcaataattctttccatttcattataaacaatcatgtaaccttcatctacacccatacctggttttgcaagaatctggtctggctgtgttgccattgcgcagtttacgcaaacctgtgcagaacggtctgtttcattacaagtaccaccctggtaagctccaaatcctttttctttgcagtaaagaactgcttctacgatattattgattccaccaaggtccggtgttttaatctgagccatatgacctgctttattgtctgcgaaatattttacatcttctaatgtattacaccattcgtcggcaaccaattctacattaatgcctctcttatcaacttcttctcttaagccttttaagcaaagcatctgtttttctctttcttctgcatccatcggtccttcaattcttaaatggaaaggttttgcagcttcttcaagttctgcaagataatctgccatagcggtaaagttatctactccgaagattgcaccgattgttccatatacgtcgatatggaataccggcatataactttcatcatggcgaagttttaatacacgatctctcaaccattctacatattcttttaagatttcaccatgttcgccaagttttgtctttacattattgattaatgcatgaggcataacggctgcaccttttaaaatcatcttatcagagttatcataacggttatcaccggactgtgtaaagattggaattggtttatcagatacagttgtaccatattcgtctgctactacttcgcacatcagacgttttgtggattttgctactgcatcaagaatcgcctggctgacaccataacggattgctgtgtgaagtctctttccttctacctgaaggttttctaccatttcacaaagtcctttaaagctgtctgcttcttttccaaccagctccggtttgatatatttatcgataatcggaatgaaatcttctgcaaggaagagagggtctcttccgcctgctcctgaatactgaacggctgcacaatcaccccacgcaatctgtccgtcttcaaggattaacataacagagattgcttctcctgcctgtcttacggatttaaatcccggtgttacggtttctccaaaataagccgcaccatctgctactgcaccttttttgatggctctctggtcatcaaagaaaaatcctgttcttgcttttgagcaaactacatccacaattttcataatattcttctcctattttttatgtaaaatttgttttttgattttttctttgtctttatagtctctttgagactaattttggtatttcaattttgatatctcatctaacttaattttttggtttacctaccagacgtcctttactgattgcataaacatcatcgattgtcatctggaaagaagcttttctcttttccatttttgctctgtgttcgattttgcctctgttgaaatcagcaagttctcttggaagtggaacattagctacatttaagtaacgaactgcaccttcaaagtcacgagccggaagcatttttcctgcattgtatttacttggagcaaacggaatatcaagaactccggcttttactgcacgaacagcaccaagtgccaaatctcccattccaagttcaaagcatttatctacaatcgcacaagtttcccctttaatgattgctttttccagttcaagagcagaactctttaactcctggtcagctaacagagaaattgcctgcttagtacaacgaagaccctgtgcatttgcttccattgtcggaacacccattgcttcatgcggtgtttttacgataacttttgttgcttttgcaagtgctgctacagaacttccccatgaaataacaccaaatgcttttgcttcatcctgtgggaatccacccatccactgatgaagaacacttgttacaacaacatctgaatatccgtaacggtctaagtactcttctgtcaattcttccagtacacgaagtgctgcaacgtcctgtaccaggttaccgcactgaccatatccaacggttacatttcttacaccctgttctgccgcaagcagcgcttcgataatcgctactgcatttgacatggacggcggaactaatgtaccggttaatggaccataaggctcacggttaatcgagatacctgcttcttcatagataccggtcagacggtctacatactgccagtcataaatagttctttcaagcggaacatcttttgcataaggaatgttgtaagaaataccgccgccttcataactggtaaatccacctgcatagcagatttcagttaacagtctggcatctggagtaccatgacgaacctgaaccggaatatcaaggttttcgataatcgtacggcaaccggatacaccatggttgactgccggaaaaccatttaacatagatttctgagtacgaacagattctttaattccatcctcagcttctttataacgattctgtctggtataagaatcaatcgttgtcggaagtaaatctgcctctcctttatcctgcagatactgaagcagttttacatgttcatcaattaaagcgactccggctcttggctgaatcagagttcttctctctgcttttgcttttgccagtttctttgaaaagctcttgctttctggcattgctttatgataggcaacagattcatcaaaatcaacttcttttcctgttggccactgctctaaaatctctttgcggattccgtaaaattcgtcatccgacatttttttatttctcaagtccataataagcaatctccttcttcataatctccagcgcagcaagcggataatgctgagaaagcagtcccattgctgccagaatatactttctgtctatcaggatttcagccttttccggtcttaatgaaccaggcttgctctcatcaaacagtgcatattttgcaacttcttctgtatgttttgcatgaattaacgctccacctgttgcaaccacgtattttactcttcttaagtcttttccactctgtacataagtcagaccacaaggagtaaagacctgctccagcgaaccggagtgacgttctactgctgtttctactgctgcacaggcaagtgcataatccattttttccatttcttcattatccggtatgtaatctgtatgctgttccagccagcttaccagttcaactacacgatttttattgataccggaaattttactcagtctgcgctctccgacagcttctaaaataccctttacactgtaacgcattccgatatcgccttccaccgttcgtttggtataaggttccggaagcccttttattacagtggaagcatttgccggatttccatctgctacagaatagacatctgtggtcgcaccacccaggtctacaccaactaattcccctattcccggaacttcttcccatccatcggataacagctccattgcaacaagcattgcggatggtgtcggcatgataattccggaaaccaaatccattgcttttgtaagccctttgccctgcacaatccgattcagaaaaatttcacgtatctgtttctgcgtcggctctatattaatttctcccagttttggcattacgttttcgcaaatatagacagtacgtccttctaaaatctcttcgcactcatctgctgcgtttctgttccctgcaagcacaatcggacaatcatagcttaatcctgcaagcatttttgcattgtataaaatgcactcggagtttcctccgtctgttcctcccgataacaaaataatatccggatgataatcttctatttcttttaaatctccttttgtaagttcaaaagaatacgttttccatacttttgctccggctccaagagatgcttcccttgatgcctgagcagtcagctctggcacaagaccaattgaaaccatttttaatccgccggctgcgcttgagcaggcatatttttcttcaaattcaaggtgtcccgtggtctgttccagaatcttgattgcattttcaagaccttcgttaatatcggtctctacggttgtgtaagctgctgctgttccaagaatctcgcatgcttctacatcaaccgctgttacttttgtatttgtacttccaaaatccaccaacaaaatcggtttcatttttttcaccaccccgatgttatgctaataccgcttccggtttttctacttttaaatcctcgtataaagcagctactgttgtttccggtgctgtaccaggtccaaatacacggtcaaagcccattgctttgaaacgtttttccacttcatcaaatggctgttttccaactacaatatttccgcctacatataaaagaatatcttttaatccggattcatcgcatttatcacggagtccacggcaatctaattcgccatgaccgtaaagagatgaaactaaaattgcatccgcatttgtttcaattgctgctgcaatatattcttcctgagaaaccataacacccaggtttacgacttcaaacccagcttcttcaaacgcatgctgtaaaatgctgattccgacagcatgtacatctgcgccgattacgccgattactaatttcttcttatccattgtaaaaccgctcccttccggttatttataatgtattttttattgtatctaacagtgttccgtctctatataatacgtttgctactaccctgttgcctaattctaccttcttcggaacaccggtaattttctctgcaatttcttttaactcggtaatttctttaaccggaagaccggctttgattaatttttcttttaattctttccgttttggattgactgcaattcctctctgcgttacaattacatctatggtatcacccggtgtagatttgcataacacctggtctacgataagaggaagtcttgcacgaatcagcggtgctacaacaatggctagttttgcacctgctgctgtatcgcaatgtccaccggaacctcccataatgtttccgttggaatcagtgtgtacatttacattaaaatcagtgtcaacctgggtggctcccagaatgactacatcaagactgtccactgcagcactttttgctgccggagatgcgtaacgcatggctgaaatctcctgatgttttggattttcacggattgattcaatggcttttaaatcaaaacactgtacatccagaattgtatcaaaataacctttgtttgccatatctactaaatacccggtgataccgcccatacagaaactacctttgatatggtctttttccatcatttcttccacatattttgcaactgccagtgaggctccaccagcacctgtctggaaagaaaatccatcttttaaatatccggaattttttactacctttgctgcaagtgctgcaattctaagcccaactgggtctcttgtaatttttgttgttccggaaacaatctttgttgggtcccctatctgttctacttctaccacataatctacataaccttctgcgatggaagtatcttttaatggataaggtaccaaattatctgtcagtacgacaaccttatctgcatgcattgcatctgagaacgcatatcccatagaaccacaggctgatggtccatattttccgctgcagttacccatattatctgcacacggtgctgctaaaaatgcaatgtcaattttagaagaaccattttccatatctccggctctacctccgtggcttcggaagataaccggcttttccaagatgccctgcgaaatggcttttccgacttcggcacccatatagttacactcaagtcctgtaactactccatttttaatatgttcaataattggtttatgtacatcgaagatggaacttgcattgactgttaagtctttgattcccatactggctgcttcttcgagtaccatatttaacacatagtctccatttctcatgtgatgatgaaaggagattgtcattccgtcctttaagccagttttttcaattgcttctcttacggacgctaataatttactcatcaaacgcacctccgtaaattgctttttccatttcaagtacctgggaagcacgttttacaatcggtgcatcaatcatttttcctctaagagaaataactccttttccctgtctctttccttcttcaatcgcatccatgacatcatgtgcataagcgatttcttcttctgtaggagagaatacttcattaacaatatcaacatgtcgcggagaaatgactgcttttcctgcaaatcccagactcttggcaaattcagtatcttttctaagcccttccatatcctctacatcggtaaacggtgtatcgtaggcttcaattccacaagctcttgctgcaagcaccagtcttgttcttgcataaaagatttcctgtccttcttttgttcgcttacaatgcatgtcagccgtaaaatcttctcctcctaagaagattccaatgactcttttatctgcggaagcgatttcaaaagatttttccacaccaagtgctgtctcgattaacggaagaatttttacagttccctcttctattcccgctttcttctctacctctgccatgtatgcggaaacttcctgaatcatctcggctccgcttacttttgttggcataataacatctggttttaaaggaatgatggcctccaaatcctctttccagaattttgtatccgtcggattgatacgtacaactgtctcgcaggcatcaaatgactgatactttaatgtatttctgacaagaactctggctgcatctttttcatccggagatactgcatcttccaaatcgaaaatgatggtgtcagctcctaatgtatcaccattaatcagcatgtttggtgtattgcctggtaaaaataacatggttcgtctcatgattctaaaactccccctctttttaatgctgtctccattcgtgctcgaataacgcaatcgagtgcacctttatctttgatataaatttttcctgtagatatctcaaattcatttagtgtatctaccacagctccccgaatagaatccagatgctgattggctacaacagagtcaatttccagagtcagttctttgtcatctggttcaatctggataaacaaatcactggattccagggttcctgctactgcattttttaaaattttcacaggctgtcacctcttgtctttccctcttttttatctatgcttaaagcttaattttttattttgtgattattctacaacactttttgaaacgtcggccttggccagaattttctgttcgtgttcaattgcttttttctcaagcacttctacttcttttgttgtttccgctacaaatgcttcatctttgatggattccagattaatttttacattaaacagtgctccaagaactgcggttcttgccatcatagttgctactaaagcatctgttactgctgttttatttccttttgttaccattacttccgcataaggcataatctcataagcgcgttttgcaactgataacggtactgcaacggctgcttttaatccattctgcattgcttcctgacgagctgccttttcttcctctgtttcttttggcagtgtcagtgcctgcatatataaatcaaaagattcactgtctcttttgatgtcatctaaaagatgttcacagattgcatgcatcggttcgatggcagctttcatttcttcttctacttctgcatattttttcttgccaatggtaagacctgctaccatttcagttaacgctgctgctaatgaaccagcgagggcggaaatacttccgcccccaggtacaggttcatttgaggcagtttgcatggcaaattcttgaacggtcatatttttcatgtcaatacctctttcgttttactcttaattataaacgtgtttccagaacctggtcagttgtgaatttcgtttcaaatccgcagttgctttcttccaaattgttcagtcccagatagtatgctgcacagtctaccaatgcctgaagaggaacgagtccaataatctcgcttcccattacatttacaccgtagcgtcttgcttccatacgaacagtttcaaacactgtataaatagaagtttttgtatagtttgtaagattcatagatacctgagcaacatttttgcttgggtcttctttgttctctaacagaacgcccatagctttacaatatttgaatccacctttgatattacgaatcttatcagcgatcttctgtgcaatttcaacacttgatgtgcttaaattaatgttgtatgcaataagcggcattcttgctccgattacagttgcaccaccggttgggtgaatggtgcttggtccgatatccggagtccatgtttctggatcagctgcaattttttctgccattccttcaaactgtcctttacggattgttgcaaggtttgcactgtgttttaaaccttttgcagaatcttcatataagaagaacggctgaccgaatttttctgctgcttctgtagcaacttcttttgcaagtgcatctgcttcttctactgttgttccacggattggaatgaaaggaactacgtctacacagcccatacgaggatgctgtcctacatgttttgtcatgtcgattaattttactgctgttccgattgctgttaccattacttcttttaacggctctggctctccgattactgttacaacacttctgttatggtctgcatcagaagaataatcaagaagttttactccctctacatcacggaagcaatcgataattgcgtcaaatgtttttttgtcctttgcctcactaacgctgaaatttggtacacattcaatgattttttccattgccatagttctcttttctcctttataattatgtaaatatttaaaagttgccgttttttaaaacacacacttatttttatttccattctttgtgatatacagtctcgcccgctttgattacagtctcaaccaggttaattgctgtgtgatatggcatataatgaatggatgggaatttcaggaatatgatatctgcctgttttcccacttcgaggcttccgattttatcggctctgtccactgctgccgcaccattaatggtaagagcagtaatgacttcctcgattgacatgttcatataaatacatccaagtgccaccataagtggaatggaatttgaaaaacaacttcccggattcaagtcagaagccagtgccactgcacagccttcatcaatcatttttcttgccggtgcatattcttcttttaaaccaaatgcggttaacggaagaatggtactgatgactcctgcatccctcatctgacggattccttcatctgatgcttttaataaatggtctgccgaaactgctccaactcttgcagccagttcagaaccgccaagctggtaaatctcatctgcatgaattttcagcttgaatcccatttcttttgcttttgtcatatagtactcggaatcttctacagaaaatacatttttctcggtaaagatatccgcaaattctgcaagaccttcctcttttacaatcggcatgacatgatttaactgttcatccaaaaattctttctctttgcctttccattctggcagaacactgtgaggtcctaagaatgtggaaacaatatcaaccggatgtttttcatttaggtttttcattgcgcgcagcatttttaattctgtctcgcagtccataccgtatccgctctttccttctacggtagtcacaccaaattccagcatacggtttaagcgttcttcacctgtttccatcagttcctctaaggaggcttctcttgttggaactacggtggcattaatgccaccgccgcgttccatgatagacatgtaactgtcgcctttcagtctccaggaaaattcatctgctcgatatccgccaaagataaagtgtgtatgggaatctacgaaacccggcattacagttttgcctgtcgcatcgattacttcatactcatcatttatctgtttgtctaattcttctgttgtaccgactgccacaattttatcatcgtgaatgattacggctccatctttaatcagaccaatatctgacatttcttttccatgtttcggtgcactacctttacaggtaactaactcagatgcatgacgtatatagcgttttttcatgtctgttatctcctaattttagtgatgtgtatgatgatgtggttctaccactacatctttgcatactctttcaattaattcgtcgcttgcaaggtaaggcattgtaacataatcctgaccttctctgattctgttgtattctgctacagtttcgatagagtgttcgcatctgccccagcttcttcttgatacaccaatcatagtatcccacggaatagccgcttttaagatttcgtctactctttcgcttccgtcaagtaccataccgaatccaccgttgatggatttgctgataccaacaccaccgccgttgtgaagagctacaagactcattccacgtgcagcgtttcctgcgtagcaatgtacagccatatctgctgtaatattagaaccatcgtaaatattagatgtttctctgtatggtgaatctgtaccgcctgtatcatgatggtcacgtccaagcattaccggtccgatttctccatttcttaccatttcattgaatttcagagcaatatctcttcttccaagagcatcctgatataaaatacggcactgagtaccaactaccagtttgttcttttccgcatcacgaatccaaatccagttatctctatcctggcttcttctttctggattaatgatttccattgcagcgtggtctgtttttcttaaatcttccggttttccggataagcagcaccatctgaatgggccatatccataatcaaacagttctggtccaagaatatcttctacataagatgggaaaatgaatccttcgcttgtatcttcaccattctttgcgatatcttttgcgcctgcatcaaatacagctctcatgaaggagttaccgtaatcgaagaagtaagctcctctttctacgagtgttttgattaagtgataatgttttactaatgtctgatctactaattcacagaatttatctttatcatttgcaagcatttctgtacgttcttcgaatgtcagaccctgtgggcagtaacctccgtcgtatggcacatggcagcttgtctggtcagataacagttcaatcttgatattgttatcaactgcatactgcagtaagtctacgatatttccatggtaagcaatggatactgtttctttcttatccatgtattcctgtgcaactttgaatgcttctgctgcatcttcaattacaaggcttacccatccctggctgtgacgtgtttcaattctggaagcatctacttctgcgatgataccaacaccaccggcgatttcgattgcttttggctgagctccactcattccgccaagaccacttgttacaaacagatgtccggcaaggtcaccatcctgaggtactccgaggaattttctacctgcatttaagattgtgttgaatgtaccatgtacaataccctgaggtccgatgtacatccatccaccggctgtcatctgtccgtaggaagagcatcccattgctgttgcttttgcccagtcttccggattatcgaacataccaaccatcagaccgtttgttacgataactcttgggcttgttttatgagatttgaaaagacccattggatgaccactcatcattaccagagtatgttcatctgtcagttcttccagatattttttaattaactgatactgcatccagttctggcaaacctgtcctgtttctccataagttactaattcgtaaggatataaagcaacttcatggtcaaggttgttatcaatcataacctggaatgctttaccttctacgcattttcctttatattcatcgattggttttccgtaaattctttcctttggcatgaaacgatatccatagatacgacctcttgtcagaagttcgtctaagaattcaggagcaagctgctcgtgcagttcttccggtacatatctcaaagcattggcaaccgccagtttgatttcacgtttgttcagagtaagttctctcattggagctcttcttacgccttctttgaaggtcggatactccggcagaaccgggtccagtttgattaccattgcttttccgatttcagcattattcatcatttcacatcttctccttttttgttatttttatttgtttttgatttgatttaattttaccatttcaaagtctaaaaaacgtctatttattaaaaattttttcaaaaaaatcttgctatctggtaataaaatcgtcaacaattcacaatagcaaggttttttatcgtcttcttctatgaaatttgtcaaatttctacatcaagcataaagaatcattaaacgaatacaaaaagaccgccccaaggacggcctctttgcaaggaatgatatctatgactagatatggcgtggcatgcttccatccctgaaatcaaaaatttcagggacgaaagcttcatgctcaagaatactttcgtgctcagtatccatgaacaaatcccgtctacccaacggctttcactttttacgaataatggaatattcgtatctttactgtgactataccctaacataagagtagtcaaaaaaacgcaaaaaattcatatattttttaaattttttctaattcatatacactttttaatggttttaaataatattctgcttcttttcgatagtcctctgcttcttttgtcaaaagttttttgaatttttctgaatatttcttttttaattcccattcatgcaaggcgaaaagtccctttgcataaggggaacccaactgattggcacttttctttgcctgcatcagataaagcgaagccttttcaaactctccctttttcgcttcaagcagcgccagagcccccttcgcgatcgaacgtccaatcaacatataagattcttcatacaataaatctgcctgataaaaaacgagttcacctttctctacttctccaagttcctgataaaccctggcaagattgcagtaaacagccggtgtacacggaatatgattcttccggcaaactgcaattgcctgtttataatacgcttctgcttctttaaaatgtttttgttttctctgaatttcccctatgtaattataacatccggaaatattggacgcataaatccgttcttttaatggaactcttttaaaatattccaaagcttcttccagtttttcttctgcctcttcaaattttccaatcatgccataataaattccatacaatctgcaggtaatcgcatattcttcctgatatccctgtttttgtgccagtttgagactttcttctaaaagtgcttctaaattttctgtttcccagatattcagacgataataaatcagaaatcgtaaacaatggattttttcctttgcatcctctccaatacacccaatggattttaatgccttttcaatacattctattcctcgtctgtaatatccctgcggaatacaatactgcgcctgtgtttccattaaaatcgcatgaaaacgaatatatttttcctgctgcccactctcttcgtagatatcttttaattcttcttccagccggtcacaatattctaatacggattcttctttctcctgttttattccggacataaacagtgcaaccggataatgctcatacgacttataggcataattttgcaaagcaagaatcttatactctaaagttttttctttatttcctgcaagacaatagtgataaattaaacgttcaaaacgactggcatcataaatcggactttttgcaatatattctgcaagtttactgtgaaacactctacgccttgatggagacatctgaatatgtacataacgctgagtactttcatgaataaaataaaaacgaaccgattctttttcctgtttttcgtaaataaaatgttcttcttttaacctttcaattgcctctaaaatttccagttcatcctgccttaaaattgcaacaagtgcttccatgtcagaccatgcctgacaagatgcaatcagctctaataccttcctggttttatatggaagcgaatccagacgcatcttccagacctgagtcatcggcacaacctcgtcttcttttaaatccatgcccttataataatccaataatgtatgaattaaaaatggatttccatttgtctcttcgtaaatactgtttaagaatttttctgttacattctttcttccaagacgttctactaacatctgttctacattttttcggctgaagggcgaaacaaaaatttttgtaatctgtttttcctttacaagcaccgacagactcttctttaatctatcctcccagtttaccggacaagtacccagaataaacagatttttatttcgagaacgaatcagtaaagataaaaagtccagacttgatgcatccatattttgaatattatctaaaaacaggacaacctttatctgtcttccaagttcttcaaataattttaagatcaaatttctcgctgtgcggtaactataggaaatttcaacatcttcaaacagaacaatttcttcttttcttgaaaaaagtggaaacagctggtctgccgctcttaaatattctgtcggcagtgtcatatttttctctttcaaataagtatttaattccatcatcaacgtattccacgcctgaagtgtcatatttttttctgttgccagacaggaggtacgcataatcaatactgattcttcctgaatttctttcaaaaagctctccgccagataagtttttccaattccgctctctcctgctaaaaataccgtctcatcttcccctgctaaaaatttacggtaaattccacgaagcaggcaacgctctctctctcgtccatcgccttgtgtctcatcttccttatgctcgctttcactgacccagttttccatcagttcattgtaaaattcctgaatttcttttccgggaagaattccaagttctgtatgaagtttctccgacagctgctgataaattcggattcctttataatacaaaccttctttggcatagatttgcatcatcatcatataaatcctctcatcaatcggctctgcagttgtataccgttcaaataatttttctctttttttcagggaaagatgttcaacattctgcatcttttcgtaaaggcggttcaaataaatctcttttaattttccccttttgaaattcatccagtcttcaaacgcacccgcatttttcaaataaaaattttgcagaaaatctgatttatagacttccgttccgtttttctcattttcctctaaaaaacggtcataatcactttcaatttccagttcttgatttaattccagattttgtctggtaggtgatgtaatcagttcttctccgaacactttacgaatcgtataaagcgcatgacgtaagttttttcttgccgagctttcatcacagtcctcccataaaagcgttgcaatctggtctcttgtcgctgatttttccactgccatataatacagcaaagcttctacttttttatatggaaacatcatctcctgtttatttaccagcactttcggattttgaagtaccagtatctctatcatgatttttttcctttcttatatctatacggttttcactttacagattccggcttttgcagtcgcttctgcctcattttttaattctacaggatgctcccagtcctcgattactgcaagttctccggcactcacttcctgatttgcaatcttcatactgccttcttttacataaatacataacagattataatctttttctctttcaatcacagcctgctgtgcagttttaagctgtgcggtttccattacaccatctgctccatcttttaacatcagattaaaatctacgacctttccataactgacagtcggaattccaccgtcaaattcgtccacctgatacggttctaattctactcttgtattaacaccatgaatcaaatccaggtgtccttcaaaaatcatcagataacgtttcacatttggcagactggtaaactctgatttcacagcgtctacggtcgcactgctgattcttgcctgaaagtttctttctgcataatttccatcttccggataaatgtaaagctgggtggttgttccccctgaccagttactggttgaaaattcttctgctttttttacactcattttttcactcatgatttttgttctccttctctatcatccaagatatctttactataccgcaaaatttctgcggtttcaactttcaaccttgtcagccttcccaaaaatatgatacccttacataaagtatatgttatttatcaagggggatttttttatgtatctttcaaatacttatctcgaagagggttttccttttcatgggagaaagcaaaaacagatggaagcttttctaaaaaaaagcggtctgactccggactccttttattcctactccgttctcttaacagaccaaaacgggtctattttaggctgtggttcacgttatgagaatgtcttaaaatgtatcgcaattgacgagacttatcaaggagaaggtctccttgccaagattgtcacccaacttgtcaaacaggcagcacaatctgggatttctcacctgtttttatttaccaaaccttcctatcagacagtatttaccgacatgggattttataaaattattgcaactgataccatgcttcttttagaaaaccgaaaagatggaattgtacagtatttaaaatcagaagctgcaccatttttggctgtttcttctgatgtttcacatcctgtcagtgcaattgttatgaatgccaatccatttaccaaaggtcatcaatatctggtggagacagcagccaaaaaaagcagtctcttacatgtatttgttttatcggaggacgcatcagaatttccatccgatgttcgtctcgaacttgttaaaaaaggctgtagccatctgtctaacgtctctgtacatggaagttccgattatctgatttcacacgctacttttccggattattttttaaaagagcgcgctgttatcaatgatgacaccgcaaaacttgacctcgaaatttttgcacattactatgcgcctgcctttcatattactgcacgttttgtcggagaagaacctttttctaaagttacaaatgcctataatcagcaaatgaaaacgctccttccaaagcatggcattgatgtctttgaactgccaagaaagcaaaatgatgacaccattatcagtgccacttttgtccgcagactgtttcttgaaaatcagctggaagcattaaaaaattttgttccggcttcaacttacgaatacctggtttctgaagccggacaaaaacttcgagcttctctcttgtcacaaaaggagggcctataagatgtcagatttacttaataaaaactggagtactggagttccaattaccatggctgaaattctcgatgcaagagaacaccgtgcatggattcaacaggaactgctttcagaccatactcttgaatcaaactgtgccttaatcagctttactttaaatattcccggtccaataaaagtatttccttataccgtttgggctttttatgagggaattcattttatcgaatcctgtttaacaacgcatcagcttacgttattaactaaaaaaatcatggaagaaaataccggatatgaagcattttttctaatcaaaggaatcactccggaaactttaaaatcctatatgactgcatttgaagatggctcttcttttggacgtatctttgatttggatattttgcgtcctgattctaccaaagtatcccgcactgagcttggactctctgggcgcacctgcctactctgtgacaatcctgtttttgtttgttcccgttcccgcactcattctgcaaaggaactttccaaaaaaactctttctatcattgaagcgcatttttttgaagtgttttcttcttatatcggaacacagatgacacaggcactgatttcagaagtcaatactaccttaaaaccagggctggttgaccgctatcacaatggttcccataaagacatgaatcgggaacttttcttaaaaagtgcagacagtctgtttccttatttctgtcaaagtgcacgccttggtctggaagcaggatgtcttggcacacctcttcctgaagtcttttcttctcttcgtgtacttggattagaagcagaacagaccatgtatcaggcaacaaatggagtcaatacccataaaggagccgtcttttccggtgggattttatgctgcacccttggatatactgtttcaaagaaaaccataccttctctttcttttttggatgatacaacagacgagttgtcagaaatcatcaaagaaatgttagttcatctccttgatgatttgaaactgctttctaaaaaagattctgcctctcttactcacggagagaaactttatttgaagtatcaagttacaggaatccgtggagaagcccaaaaaggatttccttctttagttcagcttggacttccactttacaaaaaacttttacaagcaggtttttccagaaatgatgccggctgtattttacttttgcactatattgcttacacacaggacagcaatttaattacccgctctgattatcagactgcacaaacgattcgtacacagcttgcctcttttttagaaaacagcagttacgaaaaacagcttgaagttcttcctgtaattgataaagaatttgtcaaagcaaatttaagtcccggcggaagcgcagatttactagccttaacttattttttatatgaaatttatcataccactattttattttaggaggtttatgctatggattttactatgcaaaatgccacattagaagatttaaacgaactaagcctattaatgaatcaggcacataagacaatggagcaccctgaatggtttgctgccgatgatgatgtttatttaaaaaagcatcttgaaaaacacggatttattgtcacagcacggacaaaggataaaacactttccggtttctttgtcattaaatatcctgctgtttcagagaactatcttggacagatactgaatttttctgatactcagatgcagcagacagtctatatggattccgctgttgtctctcctgagtttcagggaaatcatctgcagtctcgtatgcttcaaaatgccgaagcacaattaaaacatcagtttcatcattgcctgtgtctggcaaccgtacatccagataaccgattcagtttaaataatatgctgaaaaatggatatgaaattcagttaactgccacactttatggcggactgccacgttacgtgctgttaaaagaattatagtgaactactcggcaactaagttagcagagcatctaaaaaatctgcgcagagcattgaaacatgttctgcgcagatttcttttttattttaaaatttttaattcatattctctgcttcccagaccaattttttctgcctgatccagtgttgctttccactcaatattcggattggaatctttaaagtggtcgtgatggcaatgccagtcttcctgtgaaagatgttctccaagctgactgttttcaattggttttgcctttaagcaggcatccgcacatgcctgatccaatgcaaccgggtcaaaacttgcaaacattccgatatccggaagaatcggtgcatcattttctccatggcagtcacagtttggactgatatcctgtaccagtgaaatgtggaagcatggacgtccatgacagactgcctgtgcatactctgccatcttgcggtctaacaattcatttgcactgctgtttggattataaacggcatcaaaactacatgcaccaatacagcgtccacagcccttacatttatcatagtcaatcactgcttttttattttcataaataattgcatcactgccacactcttttgaacaacgatgacatccgcggcataactctttattaattgccggtttcccactggcatgctgctgcatctttccggcacggcttccgcatcccattccaatatttttgattgcaccgccaaatcctgtcgcttcatgtcctttaaaatggcttaagctgatgaaaatatctgcatccataattgcacgtccaatcagggcagttttacaatattctccatttacaaccggaacttccatttcatctgttcctctaagaccatcaccaatgataatctgacatcctgttgtaacactgttaaatccatttagatttgcgcagtctaaatgttccagtgcattttttctactgcctggatataacgtattacagtctgtcaaaaatggaagtcctccctgttctttacaaaggtctgccactacttttgcgtagtttggacgcagaaatgccatatttccaagctctccaaaatgcattttaattgcaacaaattttccttccatatcaatgtctttgattcctgctgcaatacaaagttttttcagtttgtccaactggcttgtccctaccggacagcgaaaatctgtaaaataaactgttgattttgccataattgcctcctttgattttatgtaccatcaaaatcttttttgggaaaaattataagaacttatttctcagagtccattctttccagcaaagatttagcatccagtctttgtatcggaattacttcttttggtggattttcatgttttccgagcattttttccatccatatcatatcataccatttgccaagtttgtacccacattttgtaaaattcgaataaatctcctacaataatagattcaataaaccaataacaaatccaatcagtgctccaaggttgattaccgtatgaagttcttttttcataatactcattaaaatattttctacttccagtacatccatctggtttactttttcttctaccacttctgcaatatggaactgttcggcaaatctgccagcttcctcactgacaaatttttcatataccgcttctactaccattccaattttttcttctcttgaaacaagccctcccagtacctcactgactggtctttcttctgctgcagctatttcaccaactacaatcggatggattttttcctgaccattttctttaatatattcgcccactttatttccaatcggctcggcaatcgaatgaattaaatcatcatttaaaaacatggacaccatagaaccctcaaatttcttcttaacttcttttgcgccctcttctgcaattacctttccgacatccattttatcgagtccatctaaaatccgcccggtaataaaatcttctaatttctttctcgtctcattatactgttctgattctacataacgcagtaaaaatgtctctatcgtttcatcactctctgcaatttttcgtacttcttccttgacacggcttactactgcctgcttgactccatctgataacagcatctgttctaaatctttttttgtcagcagatgttctcctactgcacttccaagtgctctcgccagacgcgcttttcctcttggaattacacctggagtaaacggaagcgtccagttcccgattttaaccggatgcaagggacgaaacagcatttttaccgcaaggtagtttgtaaaatatccgatgacagctccaatcaacggacctgacagtatttttaaaatatgcatcaatattcttcctcttttttcatcttaattttgttttccaaataatttatttctcaatttttcccatatctgtactaaaaaatactcgtaagctttatcataaataaaaagtgcagcctgtcctcccagtattaaaataagcctggctttatctgacaattttccggcaaaaaacagcttcggtgcaataaaaagtgccggaagatagagcagattaaaaaccaaaacctttgacaggttaaaataaagctttctttgtttccagtccggatgcattccaagtatccgaaataccgcctcaattaaaacaatgtaacctcccatcaaagcaaaagtaatacaatgcagtttttgaggggtaaaaagcaaacttaaaatcacacttccgataaaaaatgcaactcccgtttttagtccgtattcttttatgataattcctacacaaaacgctgctccggcaagtaaaaacaaggtattggattccaaaatccctccaaaacacaccagcaaaactgtcactgccattaaaatacccgaaacagccattttttttgcatttatatgcatgaacaaaggtctcctcccatacattcacacagactatctgcacaccataaatcgcaacagaaatttccagttccacaagcacttccactgcccgctccataaggatttcccattccctgataacgctgcgtattccactgaagacgatttaccagattattatattctgcatttccaggttccatactgaccgcctgttttgccaaattcaatgcattcatattgtttccaagtcccatattggcaattgcacttaaataataccagtgagctcctcgatttttcatgccagagagtacatttaatgcctgttgatactggcgtccatttaagtaattacttgctacctgatactgacgttgttcttcttcagaagctccctgatactgataaccggaattctgctgataagaaccactctgatatccgctttgatatccgccgtctctttctttcataatctggtcataagcttcctgtacctctttaaatttttcttctgccaaatctgcaagcggattatccacataagaatccggatgatactttctgcttaaatcgcgatatgcttttttcacttcatcattggaagcatttggagaaattccaagcacttcataaggattatttaacatttttttccttctcctgtttttctttctgaattttattataattagaccatacacctgaatagatgatatttttaataatctggctttcctcaacacatggaagatgttcaaaggcatttccggtctctgccatcatcataaccagcatttcacgtacactgttttcatactcttcttttgttcgtgaatgataaaacggttttaatggattataacttccgttctttaaatctttttccaagtcatcataagcatccataatataaataaactttccaaggaagaaaccaaactttcttaaatacggttcccatctgtcttgtttcaaaacaaacaattcttccatcagatgcccaaaagttccggctacaaggtcaatatctgtctctcctttttgttcatatacggcaagttctcgtaatctcttacagatgacacggctctgccttggatattccttacagattttctttgcctgctttttatagaaatggattcccgcaattccttttaaacttttttcatccttccagtcatcttcaaaatgataataggtcaataaaagattcatatctgcaccgtatcttgaaatttcattttgcaaaaccggaattttttttatcgggtgtaccggacatctcgactcgcttttttcttctttcggttcatataaggaagtcaacaccaaaaccagaaaggtaacgtcataactaagtgtcactcttccctttaatccataattctcttgaagacttttgcaaagcccgcagtaataagccttatatcgataaaaatcttttactttcatctccggcttatccactgtaatatatccaaacatagttttatctgcctttcttttctttcgacataatctttgttattatactacagattttgaaaaaaagccattctattagatatctctgatagaatgacctccctcttattcgccccgtaatgttttttcagtgaatttttcaaacaattccttgttcgcctcataatagtccattttattctggtcttttttcagtttggtatcttctaccaagcgcagtgctcccatcaaatcacctaactcttttggacttcctgcttcttcataacccgtacaatccgaaaactttatatactctgattcatctgccggaagtacgccactgtctttatagctttcataacatccaggacttaaaaagaaaatcatactcgttccctcctggatatctaccgtaagttttgtctgtcctgctgcaaccaactgagggtctgcactgtctccctgtggaattgtataattctgcatttcaacgtgtatctcaccatctccatttaaatcttctgcctctttttcaagcacactttgaatcgaagagatttcttcatccgtcatcatttcctctgttacaaatgccacggaatagtcataatccacttttgttacgatatctttgataaaaacacctgcaacaaataaaataaatacaacgaccagtacatggattttgtaataataccagaaattatctatcttctttctggtttcctctttcatctgtggtttcttcatacttatttggtccatcctttttttatgctgattacgattttagcacttctgccgacttatgaaaagtattttccttatatctttattttgtttttagactttcttcacatttccttacttttctcttgtatccagacatccaaaagcgttataatttatgaagttttatagaaaaaggagttatctatgaaagatttaacaaaaggcaacccgacccgcttaatgctttcgtttgcccttccagtctgtcttggaaatatttttcagcttttttacagtctggcagacactcgaatcgtaggaagcacccttggaaacgaagccctcgcggcaatcggcgcgacaacggcaatcactactttattaattggctttttacagggactgaccaatggattttccattatcgtcgcccaatgctttggtgcaaaacagactgaccagctaaaaaaagcttctgccggcacttttttattaagttttatcacaaccatccttttaacggcacttgctttactcttcctaaatcctctgctgcatcttttgaatgttccacaggatttatttgattctgcatctgcttatatccgcatcctgcttatcggaatgttgattactatgctttataatgccctcgcaggaattttgcgtgcagttggagataccgttgcaccgctgttatttttaatctgtgcttctttattaaacattgtactggatttaacctttattctggtctttcatcttggagtccgtggagcggcttatgccaccattttatcccagatggtttcggttgtgctgtgttttacttatatgtggaaacgctatccgattttccatctggaaaaagcagattttcatcttgattcaaaaatggtgaaaaaactgtactcctccggtttttcgatggcacttatgatgtctctggttttctttggaactcttgccctgcagtgcactatcaatacttttggaacagatatcatcgttgcccataccgctgcaagaaaagtaacggaatttaactttttaccgatttctgttatgggaattactatgtctacgttttgcagtcaaaattttggagcaggacagtttaaccgtgtaaaaacaggaatccgacagtcactgcttttatgttggctgtgggtgcttgttattatttttctcgcttatacctgtgcaccattttttatttatctggttaccggaacaaaagaaaccgccgtcacagacccggcttccttatacctaaaagtaaactccctgttttactttgtatcttccggaatttccatcttacgaaatggacttcaggcaatcggcgaccatattactccggtcttttcaagtttaattgaactggtcggaaaaattttgattgcctttttacttgcaccagtacttggatatatgggaattattattgccgaaccgattatctggtgttttatggtaattcctttgattgtaaagtttgtccgcaccagtcaggcgtatcgggtatgaaccccttctatccctctgcgtatactaatatcgaaagcaattcttaggagttttcattttggcaacaaagattgtaattgacgcaggtcacggcggcagtgttgaccctggagctgtttataaaggaagagaagaaaaaaatgacaacctgaatcttgctatggctgtcggtaagattttatctgaaaatggagttgatgtcgtctacacccgaaccgatgatacttatcagaccccttttgaaaaagcgcagattgcaaatgaagatggagctgatttttttctttcttttcatcgaaattccagtcccatgccgaatcagtattccggagcagaatctctcgtctatgatttatcaggaacaaaagcggaacttgcaaaaaatattaatggtgcacttggcgagcttgggtttaaggatttaggagttagtgccagacctgggcttgttgttttaagacgcacccgtatgccggcagttttaattgaaacaggttttattaataacgattcagacaatgctctgtttgatgaaaaatttgatgatattgccgaggcaattgcttatgctattcttggcacacttgacgaaacaaagaccgaagaaccggaacattcttcctctgttctatatcgagttcagaccggacaattccgtcaaaaagcaaatgctgataatcagctttatgaattacaggatatgggctatcccgcttttatccttgaagaggatggattttataaagtacaggttggggcatttcatcaattagaaaatgcaattaaaatggaacgcagactgcgcttggacgggtattcaacctggattacaacacgataattttatttgacttgaatatttctcaacaaaaatggatgccggaaaaccgacatccatttttatatttattcaaatcgaaacttcaaatacacagattacatagattctgcacgttcctggatattctttttaaaattaatcacttcatgtacatattctttatccataaattcagagtgaatcataaaatctgcggttgccttgctgaccgccatcggaatatcataaacctgagaaattctcatcaatgcttttacatccgggtcatgtggctgtgcagtaagcgggtctgaaaagaatacaacaaaattaatgacgccctctacaatttttgccccaatctgctggtctccgccaagcggaccactgttatagcctttaatcgtaagccccgttttatccgcaatcaatcttgcagttgttccggttccgtaaagattatgttttttcaaaatatcatagttttctttacaccattcaattaactttggtttttcattatcatgggcaattaacgcaatgtcttttttctcgccgattgtaaatttgatgtattcattttccatgatagtttcctcctaatttttatctctgtcaattatatcatgtttcacttgttctctcaataagaaactgctacaataagtgagaagacagaagcctttaatttgacaagaaagaaggaaattcatatgaaagtactgtttttaattttactgtttcttgttctttgtccggcactttatttttactgtattatgccacgttttaccagaaaagaacaaaccaagcgttttgcccatcagctctttgcccatcgtggattatttaatccaaaattgggaatccctgaaaattctatgccggcattttcacgtgccattgaaaaaggatacgggattgaacttgatgtacaggttacaaaagataaccggattgttgtttttcatgattattcccttggccggatgtgtggaattgatattccgcttgaaaccaaaacttatgcagaattacaggagctctgccttcagaataccagggaaaccattcctcttttaagtgatgtcttaaaactggtaaatggtcaggttccacttttagtcgaaatcaaattacattctttccatacatacccttgcgctctcgtggatcagctattacaagaatatcatggaagctactgcatcgaatcctttaattcacttgccttattgtggtatcgtcgtcacagaccagaggttgtccgcggacagctttcttccaatctgaccaatcctgtggcagaaggtggatttttattaagttttcttgtaaaacatttgttaattaattgcattggcagacctgattttatcgcttattcctataaagactataaaaacttaagctttactttaaataaatgtctttataaaacaccggtttttgcatggactttgcgctctccggaaacatttgaagcttctaaaaaacgcttcgattccttcattttcgacagcttcattcccaaaaatgaatgatgtgtaaatgttttctaaatttaacatgaaccccattgttattggaatttgactatgctataatgtcaatacttaatacttggagaagaggtgaatttcatgaagctattaaaaaaataccagcatgtttggattgtacctgtatatggcattttttatttatgggcttttcaatatctcgaacagcgcaatgtaaaagctcatatcattcatttaaaattagatgacatgattcctttctgtgagtattttattattccttatctaatgtggtttctttatattgcattaaccgttggttattttgctttcatcaataaaaataagcaggaatattaccagcttatctttacattaggactcggaatgacattgtttttagttgtttcctatttttatccaaatggtcaggatttaagaccacacttaaccggagatggattttttatcagtttggtacggcatctgtaccggattgatacaccaactaatattttaccaagtattcacgtgtttaactcagttgcctgctgtatcgcaatttgcagacataactcctttaaacatccacgtacggtaaaaatagttacattcgtcttatccgttttaattatactggcaactgtgttcttaaaacaacatacgttaattgatgtattttctgcatttgcgctgaatatcgttgcttaccagatgttctataaaccacatcctgtccgtcagaaacagccggaacagatttttttaaaataatgacaaacaaaaataagcaagagaactgtatcatttacaactctcttgctttttcttttaattaaaaatctaattttaaatctaattaaatccgtaaaatttttgtgctacgtgatataccgcaataataatatttcttccacctgctcccggaagattgactgcccttcctaagattccaagtcttaatttactataaatatttatatctgcatttttaatatatttccataaatctttctttttgttcaggttttcttctgtgcctgaacgaatcagcataacagaagaaacagtcgtaatgatatccagatatctcaacatatactgtcttaaatgtttatttgaaattttctttccggcaatggtatctaccatcagacgattcactaacaactgctggtcaatcctgcgaatcatgacgtcctcatgtactgactggtcttcacgtccgataaaataacgatagaaattttcatccatataatacattgtttttacggacattaatggctgatacacaaacaggttatctacataaaatgtatgttttggaagttccagtccacactctcttaataattctgtacgataaataacagaatgcattaagatatattttccgaccggcatattcgacacttcatcccatgtaaaaatacgattctgaggaagatatttacgataacgcatgattttctttcgttttacgccctgtttttcatacacaaaattgctaatcatcatatccagagtctgcggacctgcaatcaattcctgcagttttttcaaaattgcctcaaaggcttcttcgttgacccagtcatcactgtctactactttaaaataaaatcctgttgcattgcggattcctgtattaacggcttctccatgtcctccattttcctgatgaatgactcttacaatggtcggatacttttcggcatattcatctgcaatctttgcagtatcgtcttttgaaccatcattaacaatcaaaatctcgacaagttctcctccctttaataatgaatcaacacaatttctcatataatcctgtgaattataacacggaactgctattgacagtaatttcataataatctcctttcatccttcatctggcatttgctgtattttcattctaattttttatccatatattttttgtataccgagaatgcagatggcatcggatagttttcagatgcttcttctttatcaataaaaataaaatctttgcttttttttagctctgtatcttctactaaaataaagtatccctgcatctgccattccacatgtgaaaaaatgtgctttgcattttcaattttcttaatctgaatggggaccagattctgtttttctacaaaaaaaagcacttctttttcagacagaaatccctcctggttcggaaactcatataaccctgccaaaagtccctcatccggacgttttctaactgcaaaatattcttgcttctgaatcaacagtactgtctttttttcaattctccgctttacttttccactcttcttcggatattgttcaattgtaccatgtttttttgatttacaacagtttaaaatcggacatttttcacattttggcatcccattgggcagacagacggttgctccaagttccattaaactctgattgaattcaccgacatcattttccggcatctgttcttctaaaatatactcagctttttttttcgttgacgtctttgcaatatctttttcccactcttcctgccttgccagaacccttagcacatttccatctacggcaggctttctgactccaaatgcaatcgacgcaattgctcctgccgtataacttccaattccaggcaactccagaattttatcgtaatcagaaggcatttctccgtcatacttttctacaatgacttttgctgctttctgcatatttttgacccgattataatatcccagtccttcccacaacttcaaaagtatttcttcttcacactctgcaagtgcttctattgtaggaagtttttctaagaatcgcgcatagtatctctttactgcttctactcttgtctgctgaagcataatttccgatacccagatatgataaggagtcgcatcttctctccagggtaggctccgtttctcttttttgtaccattcaagcagtggctttgctctgttttcaaacatttcagtttctcctaaaaaacagccagaaacttatctccaaccgttttatatttttattcattctctacttctgtcagcttttcataaatttcttttacactgtcaaagatatagtctggttttatctcaccttccaaaatatctttcatttctgcctctcctgataaaacacaaatggtatctatctttgcattaattccggttttaatatccgtataaagccggtcaccgacaatcactgcatcctccttatcgacacccagctttttcaatacacagtttaccataatcggctctggttttccaataaaaaacggttcttttcccgtcgcattttttagcataatgctcatagaaccacaatctggaatatacccaaaactaaccggacaaactaaatccgggttcgttgccagatatgccacctcttttcctaacataatgcaggtatttcttattttttctgacgtattctccgtatcaaacccaattaagacaatacttgctctgtcatctgcttctgttaccacttcaattcctgcactccgaagttcttccactaaagactgtgttcccatacaatagacaatctgtcccggataattttctttaatataggctgctgtcgcctgactcgatgtataaaaattttcttcgtccgcagaaatccccatgtcattgactttttttacatagtctttcaccgattttgaagaattatttgtaataaaaatatactgtgctcctctttgtctgatttcctctaaaaattcaagtgttccatcaaaaatttcattttcattataaatcgttccatccatatccaacaaatatagtttttttgattttaaacgttctgctgttttgcctgttttatctttcaatctgctcgtttctccatttttttctatcctattttaccagcttaccaaaaaagaagcaaaacgaatgaaactaaaatttaaagagtttcgtccgttctgcctccttctattttttaccaaatttaaaatttcactttaataaaaacataatatcgggcatccagcttcaatattttcataaagttctgatgccatactgctcggaaggttgacacatccatgagaaccgctgtacataaaaatacttccgccaaaggaatatctccaactggcatcatggaatccaattccaccattaaacggcatccagtattttacaggtgattcatattcataagtgccatctgcccttcttgtacctcttaatacctggtctttttgcttatacatcaaataataagttccagatggagttcttctatcggaaactgtataagttccagaaacaaaatcggtatccatgataagcgttccttctttgtaataccataaatgctgatttccaaggtcaacttccacataagtatttccaatatcatcacctgtcatactataaatagcagctcttgatgcataagccggctctcttgttaccacatcatgattcacaatattttcataaatctgctctgcttcttcgctctgatcaattcgaaatccatagcttccgccactgactgtcacaggctctccggtcatcgtgcttgtaattgtacggtcacgtcccatcgtgtttcgtcttgtcgccaagtctaaaacatattctttgatatgtgccatgactgcctctttattttctacataatttccctcttcatcatagcttaaccagtctttaatctgcataccgtctaatacttcctgctcatcaccaaatgtatatgtaatggttgcagttgcacaactgttccagatatctttttgatgaatcaatgtttcatcatcttttgtcacactcggttttgcataagctcctgttttttccactgacagctttgtctgacttgtacaaacagcttcttctaatgccgtaagcagcgttccttcgtcaatggttgttccctgtgtctcatcctgaatcacaaactgattgtccacaaacgcaatctgtgcatctgccggtgcctccatatttgcctcctgcaggcaatccagaccatctaactgcgctttaagcgcagttttgtcaaaatttgcatcaatctcaacattataatttttctttgaaaacagaccacttacccataacagcggattttgttttttcattacatcttttacatctccactgcctatatactgatatccgatatcactgcctgaaatcgttctgctttcattatttctgaaatccaattcaatttcgtaagactcaacctgttttttcaatgccgcatctgcttttttctccgtcatattggcacagtccattccattgattttactgcctgcaaacaaatgattggtataataaagcgctcctgctgcatatcccacaaccaaaatagctgctgctgcacctgcaatcatcgaaggtttcagtttcttttttgcgttacctgtctcatcagaaatttcggaatctactatctgttctgctgttaccggtattggctcaactgctatagcggaagccactgcttcttctgaagatggctcttctgaaggtgattctttgaacggttcttcttcggatagttgttcttctttgacatattcctcttccttgagagtgctttcttcctgttcttctttttctacaggtacttcttcttttgaaatttcctcttggtttacgttttcgtcttcttgttttgcgttttcttcttttccggcttcttccttcgctgaaacagcttcccttaccgcctcttccttggaaatttcctcccctattgtttcctgaatgattttttccattgcagaatcaatctgtttttctatttcaggattttcaccagcatgttgctgtgcctgcttttgtttttccattgcccgtttttttgcagcttccacttttcttcttcgggcttctgaacgaaacggctgctgatttttattcttttttgttgtatctttcattatctactactcctgcaactactacttttcttttccatccaaattcgacacttgtacattataacacaaattttcctttattggtaaaattaacgaaacctaaataaaagttaagaaatttgtaataactagcgtatcagaaatagtaaagcaacccttttgattttttgccatcctcgaatgcttatctgcagtaaagcggacattcgcaatccgcttcgctacttgctcatgaacgcagtcgctttgcgatctgtcagtgggagctttcaactcccactgacagaagcatccccctcacccgccgcttagtgctctgcgcacttgaagcgggggaatgcttatctgcgttcaaacacccttagtataccacaaaaggatgccatattcacactgacatccttttctttttctttactttttttctttacttaggcttctttaaacatcattctgaaaatttttcttaccagcggacctgcaaagaaaatctgccagcagagtgccattgggaagtttaatgcagtcgtttctgcccataccgcaattatatctttcccggcatgtttaaacaataacgtagctgcaaggctcatgcttggacacatcaggcatactgttaccgctgaaattgcaagcacaatcataatctgcgcatcttttcccggtgttacaaatccaaatgcaattttttttgataaaaatccaaataagaagaagtctaaaataaacgcaattggtcccataatcactaattcatgaaaagcaagtaaaaagacttcatttgtcattccacctttgttaagcgcaatgttatagataatcattgcataaaccataacgaacaccatcataattgtaaatactacttcctgaaactttgtttttggcataattttaattcctttctctcgttcaattctctacaaaaaatatataaaaacaaaaaaacgtgcagttgcaaaggattttgcgatcgttttgcaactgcacgtcgtggttctattataccaaaactttatgcactatataatactttaagttctacaaactttatgtgaatttttctaatttcacatacaatttgcataataatactgtttttttactatgcaacatgaaatgcaacacaaaataaaaaaagtaccgtaaatacagtacttttaaagcaggggatgagggattcgaacccccatcgacggttttggagaccggtgctctaccattgaactaatcccctatattctttttttaatacatttccttaacacgtttatcattatacaataaataatctgttattgcaagctgttttttttattttttgaaatgtaccttcaaaactacatatacaaaaccgaaaccatgcagacacttgccgctccactgatttctcagcttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcctagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcttttggattgccacacggtttttcctatgtgactcctccttcgcttgccccgggattccattcccgggttgtgctctccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtatcaaatacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctctttcccacaaggtttctcgtgtctcgtggtactctggatcctgccttgtcctctttcctttcccatacggggctttcaccctctctggctggctttcccaaaaccattctggtagaatcaaggaatcaattccgcagtccgaaccccagcatgcacgcacactggtttgggctctttcccgttcgctcgccgctacttaggaaatcgagttttctttcttctcctcagggtacttagatgtttcagttcccccggttcccttccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctttcttcatcgctgtatttctacagcgcctcgtttcgtctctatcttacgttttacgtattttagatgtttcgtatatgcagttttcaaggtacattcagatgtaagtttttgtaatgccatgaccggcagaactttgttctggaggctgcgaacatcacactcactcttattcatctttcggctgttttatcagccattcaaacacaaaaatcttttatgcttgaatcactaataaaaccatgattcttttttttgtaatccggcagccacctgcttttccatgccgtctccagcatagtatcatcggccgcttaagtcttaaccatcgtgttcgggatgggaacgggtgtctcccctaagcgcatcgccaccggaaatgttttgttattaaattttagaagttttccttccttaataactcaacagtgaaacacttacgactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcttccaggttatccctggcagtctccacagagtgcccagctttacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtatcatgcgataccgtgcgcttatgcggtattagcagccatttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgtttttatgtgtttcactgttcagttatcaagcttcctgtcgttctttttatcagcgacagcttttatattatatcaaagctgtttttgtttgtcaagaacttttttaacttttttcaaagttttttgttactttcgaactttttaactttttgttgcttttatttcagcaacttgtttatattatcatctttccagttatttgtcaacaactttttttatttactgataatatcaataaagttctgtattttctctgtcacttatcagcgacaactctgatactatatcacagctgccgccaagtgtcaacgttttttttatttttatttaaatatactgcattacttcttttaaatttgccacaccaattagttgtatcttaaactttcccttcaatccttctaaatttgctttcggcataatgcaagttgtaaatcccatcttttctgcttcttttactctctgctgcgcctgactgactccacgcacttctccggaaagtcctacttctccaaatatcaaagtttcctcatctataacacggtttttataacttgaaataatcgctgccacaattccaaggtcaattgccggttctcccagtttcattccaccagccagatttacataagcatcacactctcccaaagataatcctacccttttctccaacactgccatcaacaaattgacacggttgtaatcaattccaactgccgttcgtcttggaagcccaaaattggttcgcgttatcaatgcctgaatttcaattaaaattggtcttgttccctctaaagagcagacaacaacggaacctgacgcatctgtcggtctgccattcagcataacttgagatggatttttcacttccactaatccttgttcccgcatttcaaatacaccaatttcatttgttgaaccaaagcgattttttactcctcttaaaatccgataagaagcatgacggtctccttcaaaatacaataccgtatctaccatgtgctccagtactcttggtccggctacacttccatcttttgtcacatgtcctacaataaacatggaaatccccataccttttgcgattttcattaatacgcctgttgactccctgacctgtgatacacttcccggtgcagaagaaacctcttcattatacatggtctgaatggaatcaataatgactgcttccggcttttcgttctcaataattgcttttattgtctcaagattcgtctcacataaaagtttcatcttatctgtaaatgttccaattctctgcgcacgcatttttatctgacgcagagattcctctcccgaaacataaagcaaactgtgacctttatctgatagctgtttgcacacctgcagtaacaaggtagattttccgattccagggtctcctcctaccagaaccatagaaccttgaaccaatccacctcctagcacgcgatctaattcctcaatgtttgttgtaatacgattatcctctgtaatatcaatttctgagatggtagccggttttattctttctttttgtattccctgaccatttccagagattcctgaactctttggcagaaccgtttcttccacaaatgtattccattccttacagcctgggcactgtcctaaccatttggggctttcatatccacagttctgacaaaagaagactgttttttttgcttttgccatttttttctcctatattgtctctatattgcttgctatggaacaaaaacagccgaggaaaattcctcggcccgaatttgtatttcatgtgaatgactcggctgcaattaaccaagcttcttgcttaaactgcttattatttcttcttaatctcaactgctacctgttcagactgttctaattctacactgatggcaagttttccacccagatttgttttcataacgcctgcttccacgttatcaatcttgatagaatattctgcatcttcttctaattctactgtaatctgtgcatctttcggtccttctactttaaagctcatgccatctgcttctacattaagatttaaaacagtcgttcccggaacagattcatatacaaacatgccatttctttctaatttggtaatctcattatatgtttttactttatacatgtcaccatcatgttcaaaatcagataattttgattttgtatccaattcataatttccaaaactgattgtgccatcttcctctgtacgaattaattctttaattactgacataattatgtcctcccatatgtctttcgttagtaaacttttctttataaaccggatgcttccatttgtgttgtgtgaaccataatcagctattaagcctcacaccttttcagcttaaaccgtctttataaagttttgcttacatgaatattaccataaatcaaactttttttctagtttttctagtcatgttttaccataaattttattttttccttagaaacgccgattatcaccttatcgccctgtttaattcttccctccaaaatttcttctgccatcgcatcttcaattttattctggattgcccttctaagcggacgagcaccatatttcgggtcaaagccctcttttgcaatcagctctttgaccgaatcacgaactttcaattcaattcccatctggtctttacaacgcagggttaaatcttttaacagaattcctacgattttcttcacttcttctttatttaacgtatggaatacaataatttcatcaatacgatttaaaaattccggcttaaacatccgttttacttcttccattacgccctctttcatacggctgtaatctttcttctcatcttccaccgcaccaaatccaagacgttttggttcaataattgcctttgctccggcattagaagtcataataataatcgtttctttaaaatcaatctttctgccctgtgcatctgtaatatgtccatcatccaatacctgcagtaaaatattaaagacatccggatgcgctttttcaatttcatcaaataaaatcacactatatggatttcttctgactttctcacttaactgaccaccctcatcatatccaacgtatcccggcggtgaaccaatcattttagagacactgtgtttctccatatattccgacatatctacacgaatcatcgcatcttcgcttccaaacacagcttctgccaatgcttttgaaagttccgtctttccaacgcctgtcggcccaagcaggaggaaagaacctatcggacgcttcggatcttttaatcctacgcgacctctttttactgcttttgcaactgctgacactgcttcttcctgtccgactacacgcttatgcagaatctgttccagttttgccagacgtttcgattctccctctgccagttttttgaccggaatttttgtccactgtgcaaccacttctgcaacggaatcttctgttacgacaagatgttttctgctgcattgtttttcatatttctgttttgccttttccagttcttcttttaaagtatcctgctctctttgcagttcttttgccagttcaatgtctccacattttaaagcttcttcttttcctgaaatcagtttatgaatcgtttcctctttttccacaatgccttccggtactttataaccggcaagctgtacttttgatgacgcttcatcaatcaaatccagtgctttatccggtaaaaaacggtcattgatatagcggacactcatatctactgctgcttccaatgccttttcttctatttttacaccgtgatgttcttcataatatggacacaagccttttaaaatcgcaactgcttcttcacgacttggttcttccaccgtaattggttgaaatcttcgctctaatgctgcatctttttcaatgtacttacgatattcatccaaagttgtcgcaccaatcagctggatttcccctcttgaaagagacggctttaaaatatttgaagcatcaagtgctccttctgctccgcctgctccgataatggtatgaagttcatcaataaataaaaggatttccttatcattcatgacttcctgtaccacttttttaattcgttcttcaaattctccacgatatttacttcctgcaaccatgctggaaaggtctaatacaaccacccttttatccagcatcttttccggtaccattccccagacaattcgctgtgcaagtccttctgcaatcgcagtcttaccaactcccggttctccaaccagacacggattatttttagttctacggcttaaaacctgaataattctcgaaatctctttttctcttccgataacaggatctaattttccttcttctgccatctgagtcaaatcgcgactatactggtcaagggttggagttacactgcctgtctgtcccttcataaaactgccattttgaatttcttctttagaaatcatatcttcttttcccatagcttttactacattaagatataatttttgtatattgatgccaagtgtatgcagaagtcttgttcccacacagtcatactcttctaacattgccaaaagcagatgctccgttccaatcgtacgtgatttaaatttaccggctgcctctcgacttctaaaaagcacactctcaacacgtggcgtatatccttgcggattttctaaaatcacttcctctgtcggtgtaatcaatttatcaattaattccattaatttttcagaaacaaccccctcttcacaaaggatttccgacgctgttgttccggtcgccaacaaaagccctgcaagcaaatgttccgtccctatataattatgcttcttgctttcggcagtttctttcgcttttttcagcgccaacaatgcctgttttgaataattttctttcacgaaaagcctccttattatttcatgtcctgtttttactgtcctattcgtcaaccagatattcgcaatccactttactacctgctttattcatactcttcataaatttcatcaatcaaagcatgcacttcttcttttgaaatatttctacagcttcccttcgcaagcaatatagcaagtgtctctttcatctcctgtaacgctctcgctttatttacatcaacagcaatcactgcacctcgtctgcggtctatattgacaaatccctcctgccgtaaaacagtataggctttatttacggtatgcatattaattcctatcgtatctgccaattgccttacagaaggaagattttctccctcctgaagctgtgaggttgcaattcccataataatttgattacaaagctggacatagattgcctcatcgctgttaaaatcaatttctattaccatttttccacctgcttcctctttggaattgttatatatagaataatgtgaactgcccatcacctaaaagtaatggacttcaaaggagccgatgctcctatttaagaagtttgatatttaagtttccacctgaaaattcaggcaattctcattcttatgggcgtgtccacttcgcctctgttgtatagggtagtcatatccactacactacttttacacataatgtttagcgcattgcttacattattatatcatatcttttactgaaaagataatattttagttaaaaattaaatgcagtaccctttatccgttactgttcactccgttcacagtaacttggtcaaaatccattccacatcacctacggtgatgggattttgccctgtatatctcgggattttgccatattcatggcaaaacacctcgcgggatactacctgtgaacagtaacctttatcctacaatctattgagaaatacaaaaagcagattatgaaagcaaaaattcataatctgccctgttctttttttctgaatttatttcattccaagccttaaaatcattctttaagccagcatcattctgtcatttgcaaactctccaccgcttacttcttcaaatttcttaagcaggtctgctacctgaagctgttttttctcctcaccggaaacgtcataaatcactcttccttcatgcatcataatcagacgatttccgtgtaaaattgcatctttcatattatgtgttaccatcatagctgtcagattgtggtcactgatgattttatcagaaagcgctaatacctttgccgctgttttcgggtcaagcgccgctgtatgttcatctaaaagcagaagttttggtttcttaagggatgccatcaataaggtaatcgcctgtctctgtccaccggaaagtaatcctactttactactcaaacggtcttcgagtccaagatccaaagttttcaatgattctttaaatgattctctctcttttttcgtaattccccatccaagtccacgtctctgaccacgtcttgccgcaattgccatattttcttcaatcgacatggttgctgctgttcctgtcatcggatcctggaacactcttcctaaaaatgctgcccttttatgttccgataattttgtgatatctaccccgtcaatcacaatttttccggcatcaatactccagactcctgcgattgcatttaaggttgtcgattttccagctccatttccaccgataatcgtcacaaaatcccctggatttaaatttaaatttaccccatttaatgccactttttcattgattgttccggcattaaatgtcttatgcacgtcttgaatttctaacatgtatcccattatgcagtcctccgtttcttgaaatatttctctttcatataaggaactgccaggaagcaggcaactacaaccgcagaaaacagtttcatataatcagacggcatcttaagccacagtacaaatgcaattacaatataataaataatcgctccgaaaaagattgctgcaagagttaatgcaaatgcgattttctttcctgcacataattttccaaaaataacctcgctgataataactgctgcaagtccgattacgattgcacctcgtcccatattgacatccgctgcaccttgatactgtgcataaatcccgccacaaagtccaactaatccatttgaaatcattaatgccagaactttgttaaaggaagtattaattccctgcgcacttgccatctgtggattacatccggttgcacgaatcgaagatcccagttctgtaccaaaaaaccagtaaataattgcaattaatgcaaccgcaccaagaatcagttttaagaagaaaaaggcacttccttctccggttacataacgaagagaggcaactaatttatactgaagcacattaattgcctgattggattttcccataattccaagatttatcgaatacaatccaatctgtgttaaaatactggcaagaatccctgggattccaaatgccgtatgtaaaattccggtcacaaatcctgctgccattcctgcaagaaatgcaaaaacaagtgcaagtgccggattcataccgccacggattaacataaccgcaaccgccccaccggtcgccagtgaaccatccactgtcaaatcagcaaaatccaaaatacgaaatgtaatatatactccaagtgccataattccccagataattccctgtgccacatttccgggaagtgcacgcacaagtgtcattgggtccaaggctgcaaaataaactaccatttttttatccttattcctttatttttcttgtttcaacccacagtcggtaatttcacagagtctgacatgtcagcaaaactctgactgtgttttacctcatgtcagtggggggataccgatttctctccgcccaccactgccattaaccttcctgtttgcaattcctctcaccacctatagaggtgggagaatccttgctatatttgttaaacgatatactctcgaagcctttcctcctacagtatgcaaaaataaccagacaaatagcgcagactaaaaattcatcctgcgttatttgcctgaaaatcaaccttatactacactactgcacagaaaaattccaagagtaattcattctgttcttttattcctgctcaattgcttcatattcatccggaacttcgatgccaagttcttcacaaattgtcggattatacatctttgttacatttggtgcagtctcgatttccatagtacttatatcttttccgttttcaagaatatcataagccatttcaccagctttgtatccaatatcataatagctgatagaaagggttgcaataccacatccggcacagataccctgctctcctgcaactaccggaactttagccggcagacagatattattaataatttctgtatttgatgccattgtattatccgtcggaatgtaaagtgcatcacactcggaaattgcagaagttgtaacagactgaatctcattggaatctgctgctgtatattctttatactcaattccatcttcttttaacgcatcttcaaataattttgcctgataagcagagtttggctctgcagagcaatataaaattccaactgtttttacatccggaactaattcaaccaacatatcctcctgctggtcaatcggtgccaggtcactggtacctgaaatattcattccggttgaaccattccagtcagaaatatcaagtgcagttgcataatctgtaatagaagttcctaaaatcggaatggaatccgttgctgctgctgcacactgaagtgcggttgtcgcatttgcaagaatcaaatccacattatccgcaacaaagctattggtgatggttgcacagtttgcctgctcaccctgtccattctgaaggtcgaatgtaacattatcctttccgaatttttcttcacacgcatcttcaaatccctgtgttgcctggtcaagtgcttcgtgctctaactgctggcaaataccgattttgtatacttttccggaatcagaagaagcactgtctgaagaactatcggaagaacctgaagaagaacttcctccacatcctgcaagtgatgcagctacagatgctgccattaaaactgccataatttttcttaatttcataatcttttcctcctttttcctcaatggactcttcgctttaaaccgttaccctttaaagcgataaatcatatagaaattataattaagattatagccacttttgtacctttcgtcaactaaaaaaacagcctgaattcattaaattcagactgtttcttcccattttattttttcgacttactttttatgcttcatcaatggcttttccaatgtcatttctcatgtatttattctcaaaagaaatccattttgttgcctcataagcatttgcacgggcttcttttaaatccgcaccttttgcagttacacctaagacacgaccgccattggttacaatttttccgtccttaaatgcagttcctgcatgaaatacataatatccgtctttttccttaaacgtctccaacccttcaatcggaaatcctttctcataggaaaccggatatccatcagaggctaaaaccacgcacactgctgcattctcttcaaactgtaaatctattttatccaatgttccatcaatgcaggcttcaaatacttccacgatatcattttttaatcttggaatcactacctgcgcttccgggtcaccaaatcttgcattatactctaagactcttggtcctttctctgtcagcatcagaccaaagaaaataattcctttaaattcacgtccctctgctgccattgcatctaccgttgcctgataaacatatttctcacagaactcatccacttcttttgtgtagaatgggcttggagagaaagtacccatacctccggtatttaatccctgatcaccatcttttgcacgtttatggtcctgtgcggatgtcatggttttaattgtttttccatctacaaaagaaagcacagaaacttcacgtcccgtcataaattcttcgattaccagagtatttccggcagaaccgaatttcttatcgagcatgatggtttttaccccttcttctgcctcttccaaagtgttacagattaaaacgccctttccaagcgccaatccgtctgctttcaacacaatcgggaaatctgctttttctcttaagtaagcaagtgcctcatctgcactttcaaaattttcataagcagcggtcggaatattgtattttttcattaaatcttttgaaaaagcctttgaaccttccaaaattgctgcattttttctcggtccaaatacacgcagaccttctttttcaaaggcatctactactccaccaaccagtgggtcatccatacctactacggttaaatcaatttctttttctttcgcaaaagctacaagtttatcaaattccattgcgccgattgctacacattctgcatactctgcaattcccgcatttcccggtgcgcagtaaattttatctactttcggactctgtgccactttccacgcaattgcatgctctcttccgccgcttccaataattaatactttcatgtatgttcccctttcaccgctcttgttattcttttatttttacaagaccgtttactacttccactttaccatttgcaattaaatcaattgcctttggcataatcttccattctgcctcttccatgactcttctttgaagaacttcaggagtatcttcctgtttcacttccactgccttttgtaaaataatcgggccggtatctgttccctcatctacaaagtgaaccgttgctcctgtcactttcacacctctttttaagacaccttcatgtactttcaagccgcaatatccggttccgcaaaaagatggaatcagagccggatgaatattaataattttatttggataagcctttaccataatttcaggaatcacaaccagacaacctgcaagcaccaccaaatccacctgataagactgaattgtctcaagcaaagcctgattaaatgcttccctcgattcataactttttggtgaaacgcattttgcctcaatgtgatgtgctttcgctctctctaacgcataagcattcggattattactgattacaaccgcaatttccgcatttgtaattgttccactttcaatggaatcgataattgcctgaagattcgttccgcctcctgacacaagtaccgctaatttcacgtgcctcttcctcctgttattaatgtatctttggagttttttctccactaatttttgcaattgttctttgccaatcacatccaaattttatccatttttacagcaaaagggctgcggcatccaacatgccacacccccgctcattttatttatactaattttacgcctttttcaccggcttcgatttttccgattacataaggagtttctcctgctgctttgactgcttctacggtcttgtccacatccgcaggatctactgccataatcataccgatacccatattataagtattgtacatcatggtttcttctatctgacctttttcggccattaatttaaaaattggaggaattggataactgtctttttcaatcactgcacatacatcatcttttaacattctcggtacgttttcatagaaaccaccgcctgtgatatgactacatgcttttacacgcactcctgcttctttcacgcttctgagcgcttttacatagatttttgtcggtgcaattaatgcttctccaagtgtttttccaagttcatcataataagtatccaatgattcttttgtcatatcaaatactttacgaactaaagaaaatccattgctgtgaacacctgaagatgccatacccactaaaacatcccctgcttttaagtcttttcctgtaattaaatctttttcatctaccacgccaactgcaaaacctgcaaggtcatactcatcctccggatagaaacctggcatttctgctgtctctccaccgattaatgcagcacttgacatttcacatcctgttgcaacaccttttacgatttccgcaattttttccggatagttctttccacaggcaatatagtcaaggaaaaataaaggttctccacctgcacaggcaatgtcattgacacacattgcaacacagtcgattcctactgtgtcgtgtttatccataataaatgccagtttcagttttgttcctactccatctgtaccagataccagagtaggtttttccatgtctttaaatttttccatagaaaatgcacctgaaaagccaccgatatttgtcagtacttccgaacgcattgtctttttgatatgttctttcattaattccactgatttgtaacctgcctcgatatctacaccggcattcttgtaatccattttgttatcctccaattatttgttgtaatttttatatcctacttcctgaagctttgcatcttttgcaacgacctggtcttttaagtcctctttgtagtctttcagcttcttgagaagttcagggtctgaagttgccagaatcttggctgcaaggattcccgcatttgcgcctccattaattgctactgttgctactggtattcctgacggcatctgcacaattgaatataaagaatctcttcctcctaaagatgtcgtatgcattgggataccaataaccggcattggaaagattgccgcacacatacccggaagatgtgctgccataccagctcctgcaataatcactttgaatcctttttcctctgcacttttcgcatattcaaagaacacatccggttctctgtgtgcagaaataattgtcatttcatagtcaatcccgaatttttctaacatgtctgctgctttgctcataacaggcatatctgagtcgcttcccataacaattccaacttttgccatgattcaatctccttcttaaattaatatacaaaatgtctggtcttacacggacaattttacatagacttccaaaacttgtcaacaggtttcaacaggtttcgtcaagaacacggttcaattcttccgttccgacaagagaaaatcttccattttcaataatggaagcaatttctcttccctctttttctacacggataaactcaatttcttcataaggaatggtaatatccgtatgacatccaaaataagcctttcccgcatcctctttacgaagcagggaaatttcattgtcccttgcaataatctcttttccatccggattatacacagccgtatcctctgaccagctgtaacaggtatctcccaatgcaaaatgcggacccgttttctctgcaatcaaaattggaagtttggcttcgattccatattttcttcccatcctataagccgttgtgttcgttccgattgcaaattctccgatcggaagaaactcatgatgatataaaatattactttcgatataagctttattttcatctgcggtttcaaaattttcacaggaatattgcgttgtttttccatcttccagacagatttttaaatttttataatacaaaccggaaagataaactccgcttacatgaagcacaccatttgttccctccaacttcggactggtaaatacttcacccaccggaatgttgacatcggcaacacaattttcaaagttcgtttctttctctgaattttttaaggtatgaagcataattcttaaatctgtctcatttgctccctttcccttaatatgcaccgagtctcccttatccagaacatcaatcattgtctgctgaatgttttgatataaatgataatccagattatttaagcgcacggtctctttaaaaatttcacgaaaatctgctccgatttcacaaaccggataggcgataatcgtaaaactgcgttcttccccgataatataacgatttacaatctgtcctgcttcattgctgtaagtcacctttaacttctgctgatgcggatttaaactccacgcttctgctttcgtttccggttcaaatggttcttcaccaaatgtttcaatcactgccggaccagcatgcgtattggcaagttcctttacctgttcataagcgacctgcatcacccgcaattttctgcagacaaattcctgattaaaaaatagcgcattgtcttctttatggtcgtaatcatactgacggtttggaactgccccataatagccaattctattctgaccatttcgattaacagcatggactgcacttcgatagatagtcggacgaagtcccatcttggcaaactgtccaactgcagattttaccattctctcaaatccaagctgataacggatattgactgtttttttcttcgataaatcttttttacccactacaaatccgattcgatagccctcactaaaggttctcgccattttatcaatttcttcctgtgaaaactcacttaaaaatttcgccatctcttcttcattttgggtgacatattctccgaattgatataaataccgcacatcgcttaaatcactgttttcaataatcttcacagcaaaatccaaatcaggatctactgcttcacggattcttcttgaaaccatttcctcactgtaatcactgacataccagtacaatgattccctgacttcttctgccgacacaggcgattcttctaacaaattataaatctgtacaaacagttctaaaatcacagtcatatcaaacagacgattttcatagacaaatacaataagccctcttatctcagcctctaaaaagcaaatcagcggaccaaattcttttcctaacagcttctcggcataagcaggatttgcataagaagtctcatagtgttccggcagaatatcctggtacaaccgctcattatttttccttaattcttctaaagaagctgttttgagccagccatcctgaatttttccatgcagtctgattaagtattcaagaaaatcggctgttttcttaaaatatcctaaaaattgttccggcagtttctcctcgtcttttatctcaaaaattcggtccgtaaccaacgaaaaacgttcttctaaatattcttctctactcatcttttaaattcccgttttttacatttttttcaataatctgagtcaccacttccatcagcgtatccgaacccatctttgttcttttctgtctttcttctacctgagaacgtttaatctgacgctctctccaggattttcctcctgttttatcatttaacagaatcggctgtaaattgtccatacagcgggcaaactttgcttccggcgtctcgcaggtctcaaattcttcccataaatctctcatactctttgcctggtctttcggtaaaagactaaaaatccggtctgccgcctttacctcacgttccctctggcttaattttcctttttcatcataagcataagtatccccggcatcaatttccacaatgtcatgaatcaacaccataagcattgtcttttgtacatctattttctcttttgcatactcagacaaaagtgctgtcataagcgccagatgccaggaatgttctgcatcattttcttttcggattccatcagaaaggtacgtctgacgcccgataaatttacttttatctgcttctaaaataaattcaagctgttttttcaaccgttcttccataatttctacctcatccaattccaatcaaaaacatcgtaatccaaagtactgttaacagcccgtttgccactgcgcctactttgctgtacaatacattcctgttttcctctgaaaaactctttaagccaagaataaatccatatacagaaaatccgattgcaatgaatcctgctgctccgagatataatccgccttttccacccatcatcatcgagcagatagcagaacctacaaacaaaagaaacgacgcaaatgccaaaatagaggataactttccgcctttggtatgtttctttctggtaaacgcatatttatatctctttctcgccatatttcttcctcctggtctggtcatctatcaaatggcagacagcaaacaggatatacccgactgccgctcccagtgtattcaaaatcaaatcatctacatcaaaacatccaactttcgttatcagctgaactacttccacaaacaagctcaaggcaaatcctaataacgtaatcaagaaaaagcctctcgcccgacggacaattaaaggaagtataaatccaaagggaacgaatcctaccacatttcctaacagattcgtaacgactgcaaatactccaagttgttctctgtaaatccaaaatcgttttatttcccgaaacggaaccacattataatggtattcacgctctgcgaaccctgctcttccatatgattccgaaaaaaacaggaaataaatcagtgcagcaatataaagcagaaaagcaaccattcccgctttctttattttattttttatttccctgttcaatttatacgctcctgtactgaaataaagagggcattttcttaaatatgccctctctttctgacacaaggcatactcctgataagcctgtcatgccttaaattgtcagttcatatttcttttttattaatcttgctccattaataatcagcatagtgccacttacaattccggtcactaataccacaattccaattgccagtgtaccaccgcctatgcctgccattgttttatatactttttcattcataaaatcctgcatcctcttgattcatttcatacaactgactttttcatttttcaatctattttacgccatattcctcatagtatgcgtcaattgcggattttaatgtatcatcaattacaacttttccattacattctttgttgtaaagacattccactacttcttccattgttacgattgcagcagtatcaaatccataaaggtctttgacttcatcaagggcgcatttttctccaccctttccgatttccatacggtttaaagaaaccatcagaccaacgatagtcacatctgctgcccctcttaccttcggtacggtttcttccatagattttccggatgtcgtaacatcctcaatcataatcacacggtcaccatcttttaactggcttccaaggaattttcctttgtctgcaccgtggtctttttcttcttttctatcagaacagtaacgcacttcttttccatataattcactgtatgcaattgcggttacaactccaagcggaattcccttgtatgccggtccaaataatacgtcaaagtcatctccatacgtatcatgaatggcttttgcataatattcacctaacttttttaactgtgaaccggttacataagcacctgcattcataaaaaacggagattttcttccactctttaaagtaaactctccaaatttcagtacatcactttctaccataaattcaataaactctttcttgtatgcttccatttttaccaaagcctccattattcttctattttatgagcagtctgctcttttcttctaactgtatcattgatattttagcacactattttctacttgacaattcttttcacttctttaccaaacaaaaaggccaatgaaagccttgccttcattgaccctttcgcatttcatttcgagtattgattcaaaattttatttttcttcttttttctctactcctgtgtcttttcttctctttttgtaatagagaatcactcctgcaaatacaccagaagcactaatcagtcctgccattggaagaaggaaatcggtttcatctcctgtcttggcactctttgcactgctgctgcctgttgtctggctgctgcttgtctgtgcctgagttcctgttgtcttattcgtgcttccactttgcgttcctttgttggttgctgtaccggttgtggtatttgagcctttgtttgttgtaccggttgttgtaccagaacccttgttgttattcttatcggtcgttgatgtgttattatctttgttgttatccttgttgtcatctttcttatcatctttgttgcccgggtccggtttatcggtattatttgccagctcttctaagcgtttgatttctgcttctcgctcctcaagtgccgtttttgcatctttaatcattgctttctggctctcacttaaagcatcatacgcttttcttgcctgttccactgcggtcttgtctgccagtttcaaatcttttacttctgggagactgttaatctgctgtgccactttttctgcttcttctttttctctctcgagtaagctgatctggttttcagcggttaacagcatatccactactccactttctgtcaactgacgtttctggtctgcatttaatgcatcataagcatttcttgccaaagatactttttctgcatcctccagtttcaaatctccaactgccggaagttcctgaatctgttttgttacggcttcggcttcttcttttaatgcttttagtttctgctctgccttttccagtttgtcatacgcttcaccggaaacaaacttcttctggtcatcactcagagcatcgtaagcctctcttgcctgtttcagtaccgcttcatcctggaacatcacatcctcttcggacggaagggcattgagtttttctgtcactgcatcggctgccgctttgtctgccgcatcctttttcagtttttctaactgcgttcttaattcaccaagttttgcaacactttccggtgcttttccattcagatattctttctgagcatcacttaatgcattgtagtgtgcctctgcacctgcaagagccacttcatcatccagcgtcagattgtctttggacggaagcgcattcatctcttctaataccaaatccgctgcctgctcttcgagtaactgtgcaatcttcttctctgcactttccagtttgtcggttgtttccttggaaaccagtttcttctggtcatccgtcagcttgctgtacgcatctcttgcagcgtcaactgcttcctgatgttccagagtcacattttcggctgtcggaagcgcatcaatctgagcaatcacagcgtccgctgcttctttgtctgccttttctttcttaagagctgccagttgttcctctgcttttaagagcacatcgtaattacttacatatctcttctcctcacgggtcagggaatcataagccttacgtgctgtggtaatctttgcttcacactcatctgtaagctcaatggtttcatcaatctgcttgatctgattttcgactttttcaccacgttctcttgcaccaggtgtttcatccaacgcttctaaccatttattccaggtagatgcattgccacttgatgcaaatccggactcgtctttcatatcagactgttctactttgtagtcatcgatgtaatgccatacgatttcatcacctgtggttacataccattcatttaagcctctgtccgggtgtactccgtttacggtatacatccagccggaatttttaccgttgtccatttcctttaattcataaccaccataaatctccggtgcggtaatggaactaatgtagttgttttcaattcctacataagaaagtcccgcttcctctaatgcagtcttaaacacttcaccaaccgttacttctgactggtcaaaactataagtaccggttgcaatccatgtcgtataagcatgaacggcttcgttgtcacttccctcttctccgtgtttggtatcaccaatcagacggaatgtaacaactgtcttgttcgggtctgcggatgggtcacttactttatttacagtaatggaactcatcactgcagtcaagagattgtgaccagcttcatctttcttgacagccgtaaaacgatgcgttcctaaagaaagggtattggtttctacctgaagctgtccattttcatcagttgttccaatcagtttacttccttcataaatctctgcatcggcaatggcttctgcctttgcatcattttcagaaacacctgctcctgctaatgtcaaggtcagggtttctccacgattgacactctttgtttccggtgtcagatgtgcatctttcatgccatcccatccagaactatagaagaattcaaccttatctccatcagatgctaatgtattggccggatcatcacataccacaccatttaccttgcagatccagctggctttctttccgttactttctgcaatggaatcaccggtaagtacaaacttacctctgtaacattcaaaacctgctctgcttgcatcggctgcatctaacaatgcatgaagtaccgtgtaaccgccatggttatataagacataacgatttgcagccaaatcttttgcttcctgtgaaatggctacatccgttgtcgggcagaataccgtactctgtccggcaagctgtaccgataccgttccagactgagccggaactgcctctaagctttctatacggataaccggattggtttcttcatctgttactttgaaactgtctgtcttggtcaggaatccactcttagatacatagtaagtataggttccattttcaagcgtgtacgttccatcctcattggctttcatcgtcttgctgccctgcattacaagtacggatgcaccttctggaacttcgaaggttgtctgttttgaagcggaacgacgagttacgtcgatggtgtaggtactgtctactcccattcctttagctgccttacatgtcactgtcaatttgttgacaccaacttccagtggaattgcctctcccgcttcataagtttcttccgttccatttatagaaacagtgtaactctccattgtatcttttctgttccaggtatctccttttacatttaccagaatcttatctgttccatttggaacagatgtactgaaatgttcttctgttccaataaatccatatcctaaatcctgtgtaatcgtgttcttttcagaatcttcatacgtaacatcgtctgcttccagaattccatcccaacgtcccagtgcttcacttccttcagctgctgaaattgttatatcttttggaagaaacgccatcgtttttttgtttttagttttatataaatgtgttgcataagtcatcggacttccattactcggtactacaatgacttcgacctgcatttgtcgcagtgatgcctgatcaatatcagctcctgtatacaacaatggatttccaactatataattgttttcttttccataagaattttcttctttataagacttggaaaagctcatttcctgtacaacagccttacttttatcagaacccagccaatatctaaccaacagttttgcgtctttatcttcttgcagtaaatctgctcctacttggacttttaaatcttgttcactcttaaataatcctaatccacgattgacattctgtgaaatatcactatgcgctgttgcaaataaagccgtaccgctgccctcaataattgaatccccatctggtcccaaagctacagctaatgcttttaacattcctgccgaacgactcacagtttcttcattctcatcatttgagccgacctcaaatgaaatttctggaatatatgccatctttccataatcaatattcgggttatctcccccattccaataagttcccatggaatttcttgttaatttacgatgtgcaccatccgttgttccccaggcacttgtacttaatgcaccatctgtaatttgataagttccagcatcttcatcctgcagtctcactataaaactactacctgccatatactgtccaaatgaagctgtatagtccgttccatttgttttacaagtaaactgcacaccacttggattatagattgccgacattttaaacattggaggaatcatattttccattgttatctttgcagtatctccaacttccaagctttttcctggtttatacacattatcaattgtaacatccaatcctctagcaagaatcacatgatagctagtcgcatctcctgcttttatctctatgatatttcgtccttcagataactgaattgtataactctgttttccatcttctgttgtttttgcctgataggttttccatgaactgtcttttaaccaatctgtcggattttcactgagttttccatccgttacagtaatcggtttatgaacacgcacggatttaatcttttctgaactatctcctgttgttgctgtaggaataaacgtatattctgcagaatcacttatctcctgcgtaactccatctgctcctgtctgacttttaagataataaacggtacgtccttctatcatatcgatattagaagttatctgtgtctgtgttttctcttctcccacatgcacaactgcaattccagtcaattccggcagtaatgcactataaatataacttcctgtaccacttgcaatagaagcagtctccactgcatcataataaaaagcaaccagaaccgtaccctcaccatttgcatgaattcgaccaaactgtccaattttatcatcttctgttacttcaacagacgcaacactttcatctccaccaattaccacataatgccagtctgggtcattatgtgcatttgccacaccattttctactgcctgccatgcacgtaatggtactaaatcaaaatattcacctacattcaaatcaatctcactgttttctggaagatttgtcagcatactggcatagattccatctttttcttgctccctgtgtatctgcgttggattatcttcaagcggagcaaccgttacctcggtatggtcatcgttccattccccattcagattcttggtataacgagttacttttccttcctgacgcatcatataggtaaagccttcgggaatcttgtaataattatatccgtcctccgtcttaaaaggcgtataggatttccagtttctggccgtatagaattttaattcccaagtggtgtaaacttccatgtctatcggagcttttaccgtgatataactctttttcaaatatggaatttttccattatctgaaagatttaatgaaccaaaatccgtttctctgtaaacataaaaatgcccttcaattggcagatagttttcatcaaaagatgtaaatttaaaattataataactgtcgccaccacaattcggaacaacataattatacacatcatctgtggcgtgccaatattctttctgctgcttttcatcataaagacttagtgtaccaagttcgggaagatatacccgttgatgtttttcattaagccaagctgttggagaaacattcttaaaataaacacttgcaagctttaattccgttgtatcttcagtcactgtaaaatatccacccgcaccgttcaatgaatcctctccatcacccgcatattcatagcagtattctcctggatttacggtaaaacttttatcttttacctcaatttcttgttttttatcagcagtatatatttttacgttactgatgccagtaagattaattaccctatcggtattttctgctgcataaacatttactctcaatattcccaacaaacacattgtaagcagtagatagcggagtatttttttcatttttttgttttctttcgtctctttcatttttcatcctttccatttttatttaatcttatattaactttttatttcacttcctcccttttctttttctccctcttattaagtcatcacagcgtggggagtattttattttccactgtgcgactgtaaggtttcattgtcacgactttttcactttccttccttttgctgtctgtcatgacaataaaaaaagcccgtacaaccgaaaggtcatacgaactgatttctcatcctcgaactacagatattccacatctatttaatcagataataaagggtactgtttattcttatgcttcagtcaattcgttcctggcctccgaattttcttaaatgttaaagatgcttttttacgctccgtcttctggctcaggaccaattaacctactcgatgtgtcttaccaaatctgattcattcagtgactttttccatctttcgttgtccttacagcagggaaaggatctgctccggattctaaccggattccgttctaagtatcatcaatacttataagcgtacacattttccaacatttctgtatgaaattctatcaatcctgtcataatactaataggattgttgcacggtaatcttagattctttccatccaagatgcctttacatgatttataataactgtaattcatagttttgtcaatgttttctgacattttccttaaatccttaggctattcgcaaagttttttatgcacttttaacaatttcttgatattctcacttctaatcaccgtcagaaagcttgtcaatttttcacaactaaggaggtttcctatgagaacaggtcaaaacatctataaacgaaaagatggacgttgggaagcacgagtctttcttggaaaaaagtctaatgaccgtccacatttcaagtatctgtatgcatcgacttacagaaaagttcttttttcgaaaaacaatcatgaaaaaatgcttactttgtcaaatgaaacaacgatttctactgctttattttcggattcggcttataaatggttagcagattcttccaggcgttggaagccagcgacctatatcaagtataaaaattttctggagaagtatattcttcctgaatggaacacgctctatgtacgtgaaattcaacaggatacttataataacttctaattcttcctaattgacgtgttgatgcaagaactatcttgtaaaggtttccctcttcattattagccaaatctgaatatattttttcttcaatgctatatatcggatacccctgttctatcaaaccttgtacataattagctcttcctggagcatcatttatttccattaatacccactgtggaattaaaatcaaatcatagacttttagcacagactctgaccgcactccttttatttgcaatgtctgcataaatgaaattgaagaagtatccagaagcgcaatatgttttttattatcaatttttgtaatcttaactatctcgatcattcgcctctcctcgtcagtatagaaatttctgtcataatattcttcaaatacttttcattatccttatgataattcagttctggatttgcaacttttattttctttattctttcctgtaaggaagatgtattgataacataagaaggcattactaagctatcatctaatcctaacattctaaatttatttggtaaatcctcaaattgaagatcgaataccgctttaattctactacaaagtttttcattttcactttgaacagcatactcatataatgataccagcacagctttatatggtgcttggaatgttgacatgcaataaaaaacctttgaagtaaaatccatttctggaagttctgtaaaatatttatccacaccgttcaacaacatgcatccagcaaaatattccgcttttctttcttccaatgtgttatccacttcaataaaatggtcaaatgatactttgtcaaatattaaatgatatatctcatgccatgcagtaaagtattgatttgcccttggaagagaagtatttatcacaggaataacttttctatctttaacaaagattgctccgctccagaatttatcttctataggcatttgaatcaatccaaatccctgcaggattagaagtgcaagttgaggagctgatgctactttcataatcgctggatttgtctgaagtataatagtttgtgttagtatttctttcttaatttcacgattcttttttataacaaggtccagattctgaacagtaattaattcactcatagtgtctacaactccattttatttcaaacaaagctaccactttcaaaactatgtgcccttaataataaattgcacataaatcgataacatcaagaagtaactcatactgtttcttcgctgtgtcgctcattttatgattcattggtgcattttgtgaatacactgtcattgtatcattctttgttggcatcgaatgatacagcatcaactcttccactgtcatattatcttcatctttcattttaaaattcaagtgtcaaattccgaaagacaaaaaacaccgtcacctttggtaaaaaaaacaaaccccccatacctttggaaatcccaaaagtacgggggtatcagttggagtatttaattcaagattttatttttcttcttttttctctactcctgtgtctttttttctctttttataatagagaatcactccggcaaatgcacctgaagcactaatcagtcctgccattggaagaaggaaatcggtttcatctcctgtcttggcactcttcacactgctgtctgttccttgttttccatttgtctgtgcctgacttcctgttgtagttccggttgtcttattggtgcttccgctctgagtacctttattggttgtcgtacctgttgttttgttagaacctttgttggttgtaccggttgttgttccagagcccttattattgttcttatccgttgttgatgtatttttgtctttgttgttatccttgttgtcatctttcttatcatcatctttattgtctgggtctggtttatcggtattatctgccagttcctgtaagcgtttgatttctgcttctctttcctcaagcgccttctttgcatcttcaatcattgctttctggttgtcacttaaggcatcgtaagcttttcttgccgcttctactgctgtcttgtctgccagtttcaaatcttttacttccggaagactgttaatctgctgtgccactttttctgcttcttctttttctctctcaagtaaactaatctggttttcagcagttaacagcgtatccactactccactttctgtcaactgacgtttctggtctgcatttaatgcatcataagcacttcttgccaaagataccttttctgcatcttccagtttcaaatctccaactgccggaagttcctgaatctgttttattaccgcttcggcttctgcttttaatgcttcgagtttcttttctgccttttccagtttgtcatacgcttcaccggaaacaaacttcttctggtcatcactcagagcatcgtaagcctctcttgcctgtttcagtaccgcttcatcctggaacatcacatcctcttcggacggaagggcattgagtttttctgtcactgcatcggctgccgctttgtctgccgcatcctttttcagtttttctaactgcgttcttaattcaccaagttttgcaacactttccggtgcttttccattcagatattctttctgagcatcacttaatgcattgtagtgtgcctctgcacctgcaagagccacttcatcatccagcgtcagattgtctttggacggaagcgcattcatctcttctaataccaaatccgctgcctgctcttcgagtaactgtgcaatcttcttctctgcactttccagtttgtcggttgtttccttggaaaccagtttcttctggtcatccgtcagcttgctgtacgcatctcttgcagcgtcaactgcttcctgatgttccagagtcacattttcggctgtcggaagcgcatcaatctgagcaatcacagcgtccgctgcttctttgtctgccttttctttcttaagagctgccagttgttcctctgcttttaagagcacatcgtaattacttacatatctcttctcctcacgggtcagggaatcataagccttacgtgctgtggtaatctttgcttcacactcgtctgtaagctcaatggtttcatcaatctgcttgatctgattttcgaccttttcaccacgttctcttgcaccaggtgtttcatccaaagcttctaaccatttattccaggtagatgcattgccacttgatgcaaatccggactcgtctttcatatcagactgttctactttgtagtcatcgatgtaatgccatacgatttcatcacctgtggttacataccattcatttaagcctttgtccgggtgtactccgtttacggtatacatccagccggaatttttaccgttgtctttttctttcagttcaaaaccaccacattcttgaggtgctgtaattgcactgatataattattttcgattccttcataagaaagtcctgctcggtcaagcgcctctttaaatacctctccaactgttacttcatctgcttcaaaagtataagtatctgttgcaagccacgtcgtatatttatggtcttttgtatccgttccatgctgggtatctccaattaatcggaaacttacaactgtcttacctggttcagcagatgaatcctgtgcttttttaatagtaagcgtactcataactgcagtaagtacattctgacctttttcatcttctagtgttgcagttaaataatgagttccaagagtcatgctgtttgtattcactacaaactgtccagactcattcgttgttcccaaacacttactaccttcataaatttttgcgccagcaattgcactgtaatttacatttttagcagacatttcttttccacttaatgttaaagtaacttctgtgcctcgctctacttctttctgttccggtgtcaaccatgcataggtcattccttccaaatcagaattataataaaactcaaccttatcaccattatttactaatgtatttgctgggtctttacatacaataccattaatttcacaaatccatccggcatttgttcccttagaatctgcatcttgttcatcatcaacagtaagttttcctctataacaataatatccaacttctttactgtcacacgctgtcagtaatgcatgtaatgctgtatatcctccgtggttgtactgcacatagcgttttgctgtcaaatccggtacttcttttggtatctcaacatcaagtgttggacacaataccgttttttgtcctgcaattcttacagatactgttccgctctgttctggcaacgcttcaagttcacctacagaaatcttaaggtctgattcttcatctgttacagaaaaactggctttctttgttacatatccactttttgatacataatattcgtagtcaccattttccaatgtgtaagttccatcttcattagtttgcataatcttattattctgcattacacgaacggaagctccttctggaatttcaaaacttacctttttagcagcactgcgacgagtgatatcaattgtataagtatactctggccatacgttaccgaacccattggcacgcctagccgcataagaaacttttaatgtgttatctcctacttttaatggaatatcctcatcattactatatactgtttcatcatcattaaccgttatagagatatcattcgtatatatagtattaattgctgtagcagaaagtttaattttatctgcttcataaggaacagaagactgaaaatgcgtctctgtaccgataaatccttgtcctaaactctgtgtaatttcggtattgttttcatctgtataggtaaaatcttctgtctctaagattccatcaaatcgtccaaatattcctttttctgaacctgaacttatttgcaaatctcctaatggaattgcaatttcatacttctttaaatttgtttgagcatacgtcatcactgaatatgtcattgggtaaccatctgacggaataactataacctctatgtttaataatcctggctctttcacggatgacgctggcactaatgaaaaacttgttatctgctgctgtccagtattattaggctttgtccagcttatttcaccccagtccaactcttttacttcaaatttagaactgtcatctccataccaatatttaacaagcagtctgctggtttccttattaaacataggttctgctcctacattaatagtaccttttgtactcttaattgccgtactatcaattaacgtcatttgatttcttggaactactgttttacttgtataaaattttgcatccaatacacttggttctgttggacgagtagtcccaccaacttttaatcctctcaacaatcctgcatctctttttgttacttcttccaattcatcattattttcaacttgaaaattgaatcctggaagataagagagttttccataatcaatattgggattatctcctccactccagtaacctgccattgaatttcgatttaacttcttatgtgcattccaatttgctccccagcctgctgttgaaagatatccatccgaaatctcaaatgttccctcatcttcctctgttagacggatattaaaccttgtacttttagaactcatatattgacccaaaccaagttcagattctacaccattagcattataatgataaaccacaccacttggattatagatcgcacccatcttaaaaacaggtggaataagacgagacaatgaaatttgcgctgtatctcctaccgctagtttctgccctggattatacatattattaatttgtacgtccattcctcttgccaagataacatgataagcaactgcatctccagcctttatctctacgatattacgtccttctgccagacttattgtataacttccatctgtattagccttataggttttccaacttttatctgttaaccagttttgaggatttttttgtatttgtccatcttctaccataattggagtatgcactcttacagatgaaattgttgttgtattttctcctgttgttgcctctggcgtaaacgtatattccgctgtatcattcattcttactgttacgccttcttctgaagtctggtctcgtaaatagtaaactgtttttccttctgttgcatctatattcgtggtaatctgtgtttctggattacttgcaccgtcctctgttacatttatgactgcaacacctgtcagttctggccaaagagcactccataaatataaatcagagccattactatcaagatcatttggtgcttccattgcatcataccagaaaacaaccagtgctttacctgctccatttgcatgtattcgtccaaactgacctgtcttgtcatcttctgtaatttctactgaggcaaccgcatcacttccaccaacaactgcataatgccattctgggtcactatgctcatttgatgccccattggatattgcctgccatgctcgcagaggagtaatatcaaagtattctcctacttttaaatctacttcactactctctggaagattattcaacatactagcataatatgtattttcagcactaactatctggtttggattgtcctcgagttctgaaactgtatatatggttttatcttcgttccattctcccttccaaccaagtcttgtaacttttccttcctgacgcatcactacattcataccatcaggaattttataatagttatagttttcgtctgactgaaacggttcataagttgtccagttctttgctgtataaaatttaacttcccaataagttaatatttccatatcttttggtgctttaacggttcgataactttttttgatatattttattcttccactatccgacaaattcaaagaaccaaatctagtatctccatatacataaaagtgtccctctatcgtttgatagtcatcatcaaaaggagtaaatatatacctataataggtatctccattctgttgtggcatcaaataagtatacacatcttctgtttcatgctgaaattcatgttttccatctttatcatatactgttaacgtacctaactctggtaaatatacatttttcgtacctacaaacgtagttggcgatatatttttaaaattaactgtaaccagttttaattctgtcgtttcctgcgtaacatcaaattctccacctgcacctgcagaatctttatatttatatgtacctggtacaacagatatcaaattcttttctgaatcaattgctatttcttctttttcatcttctgaataaattttaacttcactactttttcctgtaagttgaacatctactttattctcatccgcatgtacgttaaggggcaaaataaataataacagaaaactaattgtactccattgtagtaaattaaaaagacttctttttctctccataaattatttccttatattcaagatagccagaggttataaacctctagctatctttgtcttttctactatattatttttatattcgcttattttgctgataatacttcatcaaaataattatttgcttcatcttctgttccaaatgcccaaactactgtatcattatcatctactggaagtacagatgcacttacaatatcactaccttctacgatattggctttagaaccttctccatcaatcacacaataataccatccataatattctgtataatcttcactagagtaaccacttaatttattaccgtctgtgtcagaaatctctgatacatagcctccgtactgtgtaaaagaaatctctccttctttcatcaaactatataacgcatcgcctgctgttggataagtctgtgcagctccttcagaattactaaaaggatttccactatttccttttgctttcgccactgtcaggtcttctccgtcaaccttcatacccgtatcattatggcagtcttttacttttactgtaactcctgttgcatccgcaacgtcctctgctgattctacatacacagtcatatcgataccagcacttgtattattggtatttacgatgtgtaagcttgctggaccatattgaccagctgcaccagtaattgttactgtaccagcccaaccatctgctgtctccttagcaccatacgcataattttcaataattttaccttttccagcattaatactatcaactttcagtccgctttttgccgcatcttctgaatcaaaaccagttctctgataataagcgtttgctggcattaatccaagtgttacgctagaattagcttcgattggtgtagaatacagagtatccggtgttactaccaaatttgggtcaccatttgccgccaataccggcatagccatagacagtgttgtcactcctgctaataatactgaaactactttttttgtttgcatggttttatacctccattttttctccctcttattaagtcatcacagcgtggggagtattttattttccactgtgcgactgtaaggtttcattatcacgactttttcactttccttccttttgctgtctgtcatgacaataaaaaaagcccgtacaaccgaaaggtcatacgaactgatttctcatcctcgaactacagatattcacatctatttaatcagataataaaggggtctgtttattcttatgcttcagtcaattcgttcctggcctccgaattttcttaaatatcgggaatgttttattacgctccgtcttctggctcaggaccaattaacctactcgatgtgtcttaccaaatctgattcattcagtgaccttttacatctttcgttgtccttacagcagggaaaggatctgctccggattctaaccggattccgttctaagtattctcaatacttataagcgtacacattttccaacatttctgtatgaaattctatcaatcctgtcataatactaataggattattgcacggtaatcttagattctttctatctaagatgcctttacatgtcttataataactgtaattcatgtttttgtcaatgctttctgacatttttcttaaattcttaagtcatttgcaaagttttcttatgcacttttaacgatatcttaacattctcacttctaatcaccgtcagaaagcttgtcaaattttcacaactaaggaggtttcctatgagaacaggtcaaaacatctataaacgaaaagatggacgttgggaagcacgagtctttcttggaaaaaagtctaatggccgtccacatttcaagtatctgtatgcatcgacttacagaaaagttctttttctaaaaaacaattatgaaaaaatgcttactttgtcaaatgaaacaacgatttctactgctttattttcggattctgcttacaaatggttagcagattcttccaggcgttggaagccagcgacctatatcaagtataaaaattttctggagaagtatattcttcctgaatggaacacgctttatgtacgtgaaattcatcaggatacttatgataaactggtggaacatctggctcaaagtctttctggaagttctctgcataccatcaatacgattattaatggaagcttgaagcatacaaaaaatagtctgccgattttatgtaaaaatccgatttctaatcaggagaagcatcctctcgatgttctttctgacagtgagtcttatgattttctcttatatctaaaatctaaggattccttaaccactgttggaattcagcttgcattgttcagtgggattcgtcttggtgagctgtgtgctcttacttgggaggacattgatttgaaagaacaggtacttcatatccgtcacactcttcagcgaattcaaaacaaagaacaatatttcggagaacctaagacggtattatatctcggttcacccaaaaacaagcgggaacggactgttcctctgcatcctcagatgcttccaattttggaacggattgagagaaattaccagtcatcagattatcttttatctggaaattcgtcccccatagagcctcggacaatgaccagccgttttaaaaaggttttaaaaagttgtggcatccgggattttcattttcatacactgcgtcacacgttcgcaactcgctgtgtggaatcggggatgcagattaaggctttaagtgagatgcttggacattcttctgtcaaaatcacaatggaccgctatgttcatctgtccatgagtttcaagcaaagccaaatcactatcctgcggtttccggattcggaaattataaatcgtcaggaaactagtcaaaattatccgaaacgacaggaaaatatggtagaaacaggggtaacttcttggatagaaagaatctaagatgtctctttttattaatatatgcaacaggtcgaattttagaaccaaaaaatactatttttgtctttttttaggagaaaacaaaaatgacggagctttctggcttgtaaccacaaaactccgtcatttttgattctctttacactgcgttataaattagtggcgaaaacccacaggcaagcctatgggttttcgccactaatttataactatttaatacctctttcttttttcatttgctcaaacatatcatcccattctgattcttctctccattcatcatcagacgaaattacagctttaccattgttattataatttgtgttctgcattgccaacttatatgctttaagtccatatactccagtattcatattaggttgaaacggtaatgcctgttccctcacagcttgttttgcagccattgtaaaaaaagtagtaagatctaatccaaggttagacataagctcttgtaactgtactttcaaggtttcatccattctcattgttacatttgtatttgccatattcatccttcctctctcttctttgatattattataccatttagtatgtacatagttaatacattgttataacatttaattcatacattccaatatttcgcctgttcactcttccgtaccacacgcccaattttctgcaaatgtgagtcaaaaaatcccatcacttttgtttctcccttagatgcaagaaaaacaaagaggccgacaaaagctttcgctttcatcgacctcttcgcattttatcttacttcactttatttttttttaatatccttcattatggagcagttcatgtgtctttccattcaagaactctgcatacaatttctccatatccgcattatcatcggatactttaatcgcagattcggtatctacttcatacagtccttcggttcttacagattttacacattctcctgcttttacaggctgtccgccacccataacgcatccgcctttacaagccatcacttcaattaaatgataatttgcttctcctgctttcatacgacggaatacttcgtgtgcatttgcaagtccacttacaacacagatattgatatctgttccttcatattgaatcgtaaattctttgattgcttcttctccacgcataccaaactcggaaattgcttttaaggtttcggtatcgtgtgccggtacaaggtgacgaagcaccgcttctgttacaccaccggtaacaccaaagattttaccaccgccggaagccattccaaacggaatatccggttcttcgcattccatatttgcaaagtcgattccagcgctcttgatcatacgaacgagttcggttgtagtcagcacatgatccgtatcctgttctccttttgtaaagctgttcggacgtttgatctccatcttctttgcggtacaaggcatgaaagataccatcacagtacgtttgccttctgctctttccggatcacggtaccattcttttgcaactgcggataacattccctgtggggaacggcaggtagaaatattgtctttataatccggatactggtctaccacaaattttacccatgccggacaacaggatgtcataagtggaagttttccaccgtttttcacacggtttaagaactctgcggattcttccataaccgttaagtcagcagaaaatccggtatcgtaaacttcgtcaaatcccatctggtgaagtgcacttaccactttacccatggaactctttccttttggaagtccaaatgcgtctcctgctgccacacgcactgccggtgcaatctgtgcaatcactctggtatccgggtcttcgagtgcatcccatactgcatcgatatcggaacggatggtaattgcgcctgtcggacagactactctacactgtccacagcctacgcacattgtttctcccagacctttgttaaatgccggcataaccgttgcttctgttccacggaatgcgattccaagtgcttccacaccctgaagttcacggcaggcacgtacgcagtttccacataatacgcacttgttcgggtcacggataatggagtaagaactgcagtctaacggctgttcttcttttgtattttcatagcgtacttcttttacgccaaggcggtaagccaaatcctgaaggacacagtttccgctcttgtcacataatgtacagtctctgcagtgtgctccgagcagaagctctacaatcatttttctatatttttttaatctcttggtattagtataaattaccataccatctctcggtatttctgaacaggaggcaaataatttacctctctcatcttctactgtacacaaacggcaggctccataaatggaaagctccggctgatagcataaagtaggaacattgattccagcttttcgaatgacagaaaggacatttttctcgtcggtaaattcaacctttctgccgtcgattgtcataattcccataaatctcgtccctcctatctgatttcaattgcgtcgaagctacagttatctttacagcttccgcacttgatacattttgcattgtcgattacatgtggtgctttcttttctcctgaaattgcagataccggacaatttcttgcacacttggtacagcctttacatttatccggattaatatagtagttctgcattgccttacaggtatgggaaacacatttcttatctacgatatgttctacatattcatcacggaacatacgaatggtactaagtaccggaagtggagcactctttccaagaccgcagagagacatactttttaccatctctgcaagttcttcgaggcgctctaagtcttccatttccccttttcctgctacaatcttttcaaggatttccaacattctctttgtaccttcacgacaaggtgtacatttaccacaggattcacgctgtgtaaaactcataaagaaacgggctacttctaccatacaggtatcgacgttcataacaaccagaccaccggaacctacgatagcaccgaattttttaacggagtcaaagtcaagtggttcatctaagtgtttctcagtcagacatccaccggatggtccaccaatctgtacggctttaaattcagaaccattctttaatccgccaccgatatcataaatgatttcacgaagggtggttcccatcggtacttcaatcagtcctgtattttcgattgaaccggttaaagagaaggtctttgttccaggacttccctctgtaccgatcgtgcggaaccattcatgtccctctaagataatcttcggtacgtttgcatatgtttctacattatttaatacggttggttttgcccacagacctttatctacggttcttggtggtttggttcttggcataccacgatttccttcgatggaagcggtcagcgcactaccttcaccacaaacgaatgcaccggctccacgattgatgtgcatgtggaagcagaaatcggttcctaaaatatgttcgcccagaagatttttctcttccataacatcgattgcatgatgcagtcttgctacagagttcggatattcggcacgtacataaatatatccatcgcttgaaccaactgcataagccgcaatcatcataccttcgattaacttaaacgggtcaccttccattacggaaccgtccataaatgctccagggtcaccctcgtcaccattacatacgacatagcgttcttttactttctgatttgcgacctgtttccattttttaccggcagggaaaccaccgcctccacgacctctaagaccggataaatcgacttcttctacaacctgttccggcgtcatttcaaacaatgctttttcgagagcgctgaaaccgccggctgccatatattcatctaaagattctgcatcaaattttccacagttttccaagacgattctggtctgttttgcaataaacggaatttcatccggctgcacataagactgaccttcttttgcataaagcagacgttcaatcacttcatctccaacaacggatttttcaaagatttcttcacagtcatcttcttttacttttatgtactgaatgacatggtcacctttctggattcttaccagcggaccaaattcacagaagccctgacatccggttctttttacgcccacatgttctttctcatcatgtggtccaaattcaatggtaacacccggtgcgccttctgcgattcccagcatttttttataaattttttcggaaccggttgcaatacagccggtgcctgaacagactaaaatacggcagttataagcatttaactgcttttctgctgattctctgcatttatcaagttccgctctattcgtaattgtcatgcgccttcacctctcaattcttccaacagctcaatcactttttcaggtgacatttttggatgaacatcttcgtttaccatcaaagtaggagcaagtccacaagctccgagacaggaaacggtttcaactgtaaacatcatatcttcggtggtgtgtttctttttgcctaatcctaactgcttatacagttcttccagaattggcatggatttacgcacatgacaggcggttccgtcacagactttaatcacatattttccttttggttcaaaagagaagttctcatagaaagttgcaacactgtaagcctttgcttcggttactccaatctgttttgcggtataagtaagaagttctcccggcagatagcggtactctgcctgaatatcctgcataacaggaatgagtgatgacggttttttaccatatttttcaatgattttgtccgccacttcgtagtatgactggtctaacatacaatacctccttgttttttatatttttaaatttattatttccacctcttctgtgttacaatgattatattatacaccattttcacattttgcacaattattttcttaaaatttatcaatttgtatttattttcacaatatcatttactttttcaccagttttgtgttatactacttctgacattattactgattgttaaggtttttcctgcgcaagaaggcatcaatgtgtataattctgtatcattgactcgtctgtctgcgcttttgcgcagattttttttttgttcttttattgtcaaagaaaggaggattttttaacatgcaggacaccagaattgctttacttggaattattcttacttctcatgattctgttgaaaaactcaatcatctgctcagccagtatagttcttatatcattggacgaatgggagtcccttaccgggaaaaaaatatttccattatcagtgtcgcccttgatgctccaaatgatatcattagttctctttccggaaaaatcggaatgttgcccggcgtcagtagtaaaacaatctacaccaaaagttaatcactatcattttatatggaggaattaaaaatgtatacttacaatccggcatccacaattgcggatgaatttattaaccatgaggaaattttagaaactcttgcttatgcagacgagaataaaaataatgaagcattaatcgactcgattcttgaaaaagcgaaactaagaaaaggtctgactcaccgtgaagcttctgttttacttgcctgtcaatctgaggaaaaaaaccaggaaatctatcacctggcagagcaaatcaaaaaagacttctatggaaaccgtattgttatgtttgctccgctttatctttccaactattgtatcaatggatgtacttactgtccttatcatgcaaagaataaacatattccaagaaagaaactgactcaggatgaaatccgaaaagaagttatcgctttacaggatttgggtcacaaacgtcttgcccttgaagccggtgaagacccaaaaaataacccgattgaatatattctggaatgtatcaaaaccatttacagcatcaagcataaaaacggggctatccgccgtgtcaatgtcaacattgccgctacaaccgtagaaaattatcgcaaattaaaagaagccggtatcggaacttatattttattccaggaaacctatcacaaagaaagttatctggaacttcatccaaccggaccaaaacatgactacaactatcatacggaagcgatggatcgtgcaatggaaggtggaattgacgatgtcggtcttggtgtcttattcggtcttgataaataccgttatgaatttgccggactgttaatgcatgctgaacatcttgaagcaagattcggtgtcggtcctcataccatcagtgtgcctcgtctgcgtaacgcggatgatatcgacgcttcttcttttacaaatggaatcagtgatgatacctttgcaaaaatcgtagcctgtatccgtatcgcagtcccttataccggaatgattgtctccacaagagaaagccagaaatgcagagagcgtgtgcttcaccttggtatctctcagattagtggcggttcccgtaccagtgtcggcggttatgcggaagaagaaccagaggatgaaagctccgcacagtttgatgtcagcgataccagaagtcttgatgaagttgtcaaatggctgatggatatggaatatattccaagtttctgtactgcctgttatagagaaggccgtaccggagaccgttttatgtcgctttgtaagaaccagcagattcaaaactgctgtcatccaaatgccttaatgaccttaaaagaatatctggtagactacgcttctccagaaaccaaagcagttggtgatgccttaattgaaaaagaactggtcaatattccaaaagaaaaaatccgcaatctcgtagtggaacacttaaaggatattgaaaatggaacaggaaatgatttccgattctaactttacgtattttccattttattgacgtaggatgattcttcctatacaaggcagcggaacgaagcgtagtgggttctacggtgagcgacgctaacgtagtagatggagaatcagacacgtctacaaaggagattttatgacaactaatttaaatcaaaccccttcggcaaatcgtactcatatcggcattttcgggaaacgaaatgcaggaaaatcaagcctgatcaatgccattaccggacaaaattatgcgattgtatccgatgtacttggcacaactaccgaccctgttttaaaatcaatggagctgcttcctttaggtccggtcgttatcattgatactcctggacttgacgatgagggagaactcggggcactgcgtattcaaaaggcatatcagattttaaacaaaacggatattgccgtacttgtaattgatgcctcctttggtgtcacaaaagaagattctgagattttaaaaagaatccacgaaaaagaaattccttgcgtgattgtagtaaataaatccgatatctgtccaaactgtaacttagaagatttaccgcttccagattcagattctgccattttagtcagttccaaaaccggggagcacattcatgaattaaaagaactgcttgcacaacaagcgtcacaagataccattcaaaaatctatcgtcgcagacttattaaaccctctggattttgttgtacttgttgttccgattgattctgccgcaccaaaagggcggttaattcttcctcagcagcagaccattcgtgatatcttagaagcaaaggcaagtgcaatcgttgtacaggaaaccgagctggcagagacattaaactcacttggaaagaagcctaaaatggtgattacagatagtcaggtctttaaaaaagtatctgcagttacaccggatgatattttactgacctcattttctattttatttgcgcgctataaggggaatttaaagattttggttaatggagcttctgcactggattctttaaaggatggagaccgcattttgatctcagaaggctgtacccatcaccgccagtgcgatgatatcggaacagtaaaacttccgaactggattcgcaattatacgaaaaaagaaatcgaatttgaatttaccagcggaacagagtttcctctggatttatcttcctataaaatgattgttcactgtggaggatgcatgttaaatgaacgggaaatgaaataccgcttaaaatgtgccgaagatgccaaaattccaattaccaattatggaacttgcattgcttatatcaatggaatcttaaatcgaagtcttgagcctgtgaaagatttcctttaaaatttttttatctcaaaagaaaaaaccggatgctctcttatcgagaaaacatccggctttttcctttacagaggttattttatttggagtagaacaaccttgtatttttaaccgtgttcttttttacttttcttcttcatcctttcttgatttttttcttgctttccaggaaaatccgccaactcccatagaagttactgcaagactaatccatccccagatacttgtcgggtcaccagtctttgcattgctgcttgtagaagtagttccggtagatttacttcctgttgttcctgtgcttgttgtgcctttgtttgttgtagcagttgtacctgtagttcctttattggttgtagatgttcctgttgtagtacctttattggttgtactggtatttgtggtgttattgtttttattgttattatctttgttgtcgtcacctttattagaattatctacttttttcagtccatcaatcgctgtctgtaagtcttttgctgcattatctactgcttcctgagactctttcttttccagtgcattttctgctgtttccagtgctgtttttaatgcactccaggtttcgcttgtgtaatctgcttcttttaatgcttttgcagatgcaattactttttcaagttctgttgtgttaacttctgccggtgtttcactgtctgcttttttcagtccgtcgattgcactctgtaactcttttgctgcactatcgactgcttcctgagattctttgttttctaatgcgctctcggcaagctctaatgcacctttgaatacgttccatgtttcacttgtgtaatctgcttcttttaaatcttttgcagttgcaattactttctcaagttctgttgtgttaacttctaccggtgcttctgcttttacaagtgcttcgattgctgcatttaagtgactggttgcttcatctactgttgcctggctgtgttttgctgccagctcctcttttgcttcctgtaattctgtctgcattgctgcccaggaatcactggtgtaatcactttcttttaatgcttctgcttttgcaattgctgcctctaattccgttgttgagatctcgcctgcttctggttttacaatgttttcttcggttgcctggaatttgtaagtgtaatcttcatatcccattgcgtataaggttaattcccagtatccggttccgtctgttcctgacggtaactggcaacgaagagaatcggttaaaccaagctggatttccatggatttatgcatccagttatctgctgcaaatttggttccatagcttgcaagggctgttgtataagtactgtcatttccataatatgtccaacgggttgcatacattcctgctcccagtccaccatagtttccatttaagtctactcgtaagaattcaccataagaaccatttgctttttttacttctggttcgattccttctgcaacttttaatgcgttatcttttaatccggattcacttccggttactcttgcaccaaagctgaagcttccgtcagcgtttttcgttgcttcttttaagccattcgtcttatcagttacttctgcaacttccgtatatgcctgcaaattcttttcagagaaaccacctgctaatgttccggcattttcgactacctgatactgtttgctaaattctgcataatcagaagcttttacttttaccggtacatacttgattcctttgacttcatagtctttcatggttgcagttttttctacaccattttcggtataagtaattgttcctttgctaaatgtaatcactctgccatctgttaaaactgcttcagaagaactattccagtaagataccggatattcatttccatctgtatcataaataactgctgtgcactgataacttcctctgtgcagaccgtggtttgttgttgctcttgatacagtatcaaatgcacccttatctaactcaccttttttatctgctacgtcggaagaagaagtaagattacttccttctgcaagataaacaccttctgatgcccagtattctgcccagcttaatcctgcgtatacatatttgtattcctcttcagaagctgctactgtataagtaaactctaaatctttgtatccggttgcacttactacaatctgataatctcctgttccgtttgcaaatggtgcagcatctgtcttaatgcttccatcttcatttacaatgacagttgcgccacgtccgcttgctgcatagcttgttccatttacagaaacacttgtaatactctttacatattcctgtaaatcttctgctttaaatccatctgcagttacaagtgctgtcttttctgcatcataagttgccggcatgtcttctgtctgaagcataaagtctgcactcatatctgcatattttccttttttatcttttacaactaatgtatattttccttttttggcatctttaaatttcagcactccattttctacgcttgcatcaagtccttctacactgtactgcgcatcaaaatctgccggaaggttttcaaagttaacctttgtttctccactttttacagaggcattatctacagataaggttgcagatgtttttaccggaacataaatgtcatctaaatccatttcatagataccatttgttgtataataagttactttatcgatggtttctcccatcatctgtgcataatgtgcagaggaagtcgggcagccatgtacacttgtagtaaatccggtgcaccatgcaattttgtgtcctttccatacattttccagatgacgcataccatagtcatgaccttctttcgtgctgaatacaacggcactgatttcatcggtatcaaatgtaattccatctaaattcagctgataatccccatatttgcttgttgtcttaaattctcctgttacaccacttactttatttacggtgccctgtacttttccaaagcttacatttccgcttgcatctaccgttgcttctttgtagtaagccggtgcttcggaaagtacataataagaatagcttgcattttcaaataatgcatcttttcctgtataagttgtttcttttgtctgtccacggtttgttacggaaatggttacagagtcagaatctgttacctgtttaaatttagataaatccattccttccggaactttaaccgggaatacaatacccgtaatatcttctccgccctggcttacatgataagaaccgcctaccatactgcttgttcttgtcttgtttaaggttgcggaagaaacggagtcaactgctacactgttatttaattcggatgcatagaaatcagcatacggaatgttcattaaaacatattctactttttctgttggagtaaccggtgctgcttccaatcctgaaattgctgtctctaattcacttactgctgttgtcactgcatcctgcgattccttctttgtcagtgcatcttttgctgctgttaacttagtctgcattgcattccaggaagcctctgtatagctgtctttttgtaatgcctctgcttttgcaattgcactttccagcgctgttgtatcaatctttacttccgcatccgctgccggtgcactcttaattgctgcaagtgccgcttctttgattgcctttgaagtataagtcgctcctgatacggtatcccagctgttaattgtgctttctgttgcactctgatttaacaactttgtgcgaattcctactcgtttagaattatttgcatttaccgcccactcaagataagttttgctttccccactatcataagttcttgacggagttacagtaatttctttaaattttccgttctctaccgtaaggcttacctcaacatcatactctgaccatccatcaccatcaccatcttttgcatgtgttgtctgagtataagtgccatcctttgctacttgttctccacttgctgcataaacagatgccggtgccattcctgttaccatagatgctgtcatcacagctgccagtgcttttgtctgaaattcattctttttgctcataggttcctccttttaatgttatagcatctatcaaaagttagcattttctaacttttaatcaaaaaaaattaatgattgatgggagctgtttttcctgctattttcaagcactcccagatttttgctgccgtaattccaattaaagtgccggtgacagccccgccaattaatagtgccggtaaataataaatcaaatgaacgttgctcactacaagcattgccgctgtaagctgtgcgatattgtgagccacacctccggcaacactgattcctaaaatggaaaatccaccggcttttttcaaaatcagcatcactgccagactaaacattccaccggcaatactgtaaatcaaagacattccatttccaaataaggttcccacaagaaggattcttaaaacagaaactaagaatacttcgtgtggtttcaaaaaacataaaccgactacaattaccagattcgcaattccaagtttgattccgggaattccaaaattaaatggaattaatacttccacataactaaaaatcatagccagtgcaattaacatggcgcaaagtgaaatttttttactcacaaattttctcctgacatctatcggttaaattccaagccacatgaaaaggcaaagtaaaagaactgccttaaatacagtaaatccaatttcatttccttttaatatgccaacaccacaggttacatttcctttcggacagccatcaatacatttctggcactggaaacattcaccctgtacgatacttgtttttgcttctcttaactcaatctttgcaggacagcttcttgtacatttactgcatccttttatacaactttctctttttctctcaagagaaaagaacggtaaaatcggaagcaaagaaaaaattgctcccatcggacaaaagaatctacagaagaagcgttctatgaatgccattccaatcataagaagaatcagcaccgcaattccgattttataagccgaaagccggaagtttcctgcatgaatcatggaaaatacatcccatggacttgttcctcttgcatttccatagacgccaaagaagcacgcaagcacaatccctgccagtagtacatattttagtaaaatcagccattgctcccattcttttttcagggaaaccggttttttcttaagttttttgcagatttttaaatagattgcatgcagtgcgtctcccaaacttccaaatgcacaggcaaatccacaaaagaaacgcccaaatacaattgtatacgcacataagacaagtaaaactgccacaaaggaagtcaactcaatctttgcttccactccaatctgcgtaaacatatattttacgccaccaaacgctgcagtaaaggctgatggtaaaaacaggaaatataacaactgaatcactgcccgaagccaggtatttaattgttttttttgtttttttgaaaggttttttacatctatctttttcattctacctacaccgcctcttctaatgctgcttccaccgcattgatgattccggtagaactaaatgttgctccgcttatcgtatcgacatcggctgactgagcctcaattaaatttggaatcacatccattgccattgtcagataagctccatcttctttttccgcagataccacttcaatatccgtaatttcaccattttccacagttacttttacttgaatcggtccgccaaatccatcagcttctccttcataagtgccgtctttataagcaccttcgctttcctctgaagcatctgcatccgcctgtgtatcttttgattttccctgcgcaacctgttcttctgcattttttcttgcaagtttctcactttctaactgtgcatctaattttgcaatttcatcagttttctctctgttcgttaaaatcccgttataaccgacaattgctacggcaatcactgccacattgataaatctgactaaaagtgatttcatggtgtttcgtctcctgtattttcttctgtattctgattggagtcatcctgacccgaatcctctccagtatcttcaccggactgtactttttttgctgtctctaatgcaaggttacagccctctaaaatggagtttgaagaacaggttgctcttgaaaccgtatcaatctcttccagcgttccttttttaaggatctgtgttactactccaggaagtttggaagttccctgtactgcccgttttatgtaagcgtcattgtctgaacttccatcacctttaatttcggaaatatctgtaatcttatcttttgaaatcgtaactttcattgtaagactatatgcttcaaaatctccatcttcatttggaaggcacggtacaattacggtatactctccatcggcataaatatatttcgtttcatctggattttcattatctccattatttccgccattggtattgccgttattatcgtttccgttattggtatttccgttattgttactgttgtttccgttattattattgccgttgttattgttgcttccgctattattgttgttgttattctcgccttttgtcgctttctcagcctcttttagtgcttcttttaccgcaccgataattccttttgagctataagttgctcccgatacgacatccacatctactgtctgtttcttcaccatattttctgcaactgctcttgcacgtttaaagaaggtctcatcgtcattttcttctacaatcacaactgcttttaaggtcttatcctgaatgacaattgctaccttaatatcatcgagatagccttccgctattccataataaacaccctctttatatggaaattttccagcttctgctgttgtattgtcattgctgttattgccattctgtccgcttccatttgaggatgaattggtattctgtgaatttgaatttccatcagaagaaattgctgcctgacttaacgcatttctgactgcttcaataattcctactgaactataagttgctcctgatacggtatctacatttgtactttgagttgcaataatattggaaatcaatcccgaagcgctctgaatataactatctccatcggaggtatcaataatctgtatcgaagaaatctttcctccgcttatcactacttctaccgtaagtgctcctgaaaatcccgttcctgttccataatatgttccatctgcgtaggcagatgcatcctgtaccgttgagacagaagaagaaccacctgccggtgaagaacttccacctgaagcacctgctgatgttgatgccggtgttccgctgtctgctgcccctgtcagggcattttttactgcactgataattccatttgaactgtaagttgcaccggatacgacatctacctctaacgtctgtccggagataatcttatcaatgactccttttgcacgactgaagaacgcatcatcatcggcttcattttcaacgatctcaattgctgtaatctgcttatcttttacggtaaccgcaactttgatttttcccgcaaatccggttcctgttccgtaatacgttccatctgatacatcaaatgaaccttttgccgtacttttctgctcttcttttttgtcctcgtcttttttcttatcctcttttttctctttttcagctgtatctgcattctcctgttcagatgcatcctcatctgtctgatttttcgttgtttccggaatatcaaccgcataaaccggtgtggaatatccatgaagagaaacgccgatacaggcagctacaacaactgctgataatgccggtgccagactttttagtttcttcagtatgctcataaacttttgttactccttctttactacctctgtatcaaagtcagaagtaaaatcttctgcaataccctctgatacataaactttattttctttatcatataaaatcatatcaaattcatcactgtgtgctctccaatactcaattgccttatcttttcccataataaacagagaagtggacaacgcatcacacatcgtaccatctgcactcacaattgacaccgataataatccgctgtctgccggatatccggtagtcgggtcaataatgtgatgataagtaaccccgtcctgttcaaaataacgctcataaccgccagaagtaatgactgctttgtctgaaattgaaagcaccccaagatagctgtcatcatcatctacaccctgaatggcaaccctccatttacttccatctgtttttgtgccaagtgcctgtacatttccgcccagattcaccagaccgctttttactccacattcccgatagatatccataattctggtagaagtatatcctttcgcaattcctcctaaatcgatcgccattccatcggttttaaaagatacggtactggtctctttatcaaacacgacatccgataatttcgttttttccagaagactatccagtgtctctttagaaggaactttgaagtcacctgtggtaaatccccattctgccataatcggataaattgcaatgtcaaatgctccgtctgtggactcaccaaattccagtgcacgttccaccagataagaggcatcttttcccaaggttccaccgccattggcattgacctgtgcaatttcacttgactcttctcctgtagaaagcagtccatccagacgctcaatttccgtaaccgccttttctaccgcttcctctccatgacttccataagcagtcaccgtcatgtaagtatccatggcaaaaacatccttacttgcctcctgactttcatctgcttcaccatcggtactttcctcactgatgtcctgatttttcgcctcttgtgcctcttctttttgactgctgctatcggtgattttttgtgtactacaccctcctaaaatcattgtgcttaataaaaataatacaagtatcttttttttcacgttttttctccttactgatgttagagcctcctaactttggatagcttatcatcacttttattacttgtcaattatactctatacttattgagaatttttctcattttatcatatagccactgtttcatatattaaacagaaaaacggtatgctgtcctctctcgactcacataccgtctcttttatttcttatttttttattttaccgcaccaattaatgtattaatatcatcaatctggtttttctttaaatactcttcgattcctttaaccgtctcaactgtcgcataagggtttgcaaaatttgctgttccaatggaaactgctgttgcaccggctaagataaattccagagcgtcttctgcatttgagattccacccattccgataatcggaacatggactgtctgagccacctgataaaccatacgtacagccacaggtttgacacatggaccggacattccgccggttttatttgccagcgcaaaggtacgacggttaatatcaatcttcattcctgttaaggtgttaattaaagaaagaagatctgcaccgcctgcttctgctgctcttgccatctctgtaatatcggttacgttcggacttaacttcatgataaccggctgttttgcatattttttcacttcttttgtgattgcctctaccgcttttggattctgtccaaaggcaattccgccttcttttacatttgggcaggaaatattgatttctaataaatcaaccggttcatctgccagacgttctactacttcacaataatcttctgtactttttccacatacatttacaataattttcgtatcaaactgttttaagaacggaatatctcttttgcaaaatacatcaattcccggattttggagtccaattgcattgagcatgccgccgtaagtttctgcaatacgtggggttgggtttcccgaccacggtacattcgccacaccttttgttacaactgcacctaactcgtttaaatctacaaattcactgtattctgcgccagaaccaaatgttccggaagcggtcataaccggatttttgagttctacaccggcaagatttacttttgtattcattataattctacctccgtacttaagaacaccggtccatctttacaaattcgtttgttgtgtacatgagaatgagaatccacgtctttagactgacatacacaggcaagacaggctccaactccacatgccatcttctcttccatggaaatccagcaagggattcctttttccagtgcataattttttaatgcacgaagcatcggttttggtccacaggcaaacatcatatctgcttcgatttgattttcacgaattgcgtctactacatttccttttgttccaacactgccgtcttccgttgcaataaaaagtgttcctgctgattcaagttcttcttttaagaataaatcctgattgcggtatccggatacaataatcgcttctccttcgatttcttttgcagtctgaagcattggaggaacgccaattcctccgccaatcatcagcacttttttaccttttgcttcttcaatcggaaatccgtttccaagcggacctaagatttcaaaagaatctcctgcttctgctttggaaaattcttctgttccttttcccactacacgatatacaatacgaagtgtgcccttttcgcggtcaatttcacagatactgattggtcttggaagcacacggcttttatcattactatagacagagataaactgccccggttttgcctgtactgcaatttcttttgcatcaagccacatactgcagattccatctgcaatcatcttctgctcgattacagtacttttcatctttaactttgccatgattttctccccttattttaatgctgttaatgcaccatcaatatctgccaccatagtttctacggcttttctggatgcatctgcaaaatttgcctctccaaactctgcatactgttcctgtttataagctgcaataattccgcgggaagagtttaccactgcaccaagtccgtcttcattaaagaaatgaaccaagtcttttccttttccaccctgtgcaccgtaacccggtactaaaatataagattttggcataattttacgaagcacttttcccatttccggataagttgcaccgacaactgccccgatataactgtattcatcgcccatgcagtcagcgccccactgagcaactttctctccgactaattcatataatggtcttccgttaattaactggtcctgaaattctccactggatggattggaagtcttaactaaaataaacagaccttttttctcttttttgcagatatcgataaacggattgacaccatctgaaccaagatatggattcactgttgcaaaatcttcatcaaagcctgcatactcttttgttccaacctgaacttttccaagatgtcctactgcataagcagaagacgtagagccaatgtctcctcgtttgatatctccgattacaaccaaatctttttctttacagtaatctacggtctttttaaatgcaaccagcccaggaattccaaactgttcatacattgcaatctgcggttttactgccggaatcaaatcataagtcgcatcaataattgctttattaaactgccagattgcttctgcggcaccctctaaggtttctccatattctttaaatgcagtctcctgtacttgttttggcacataagaaagcattgggtctaaacctacgcaaatcggtgcatgagtcttttttattttttctgtcagtttgttaatcatttttcttcctccatctttttgtgtcttatattgttctatttatttaaaattttttgctgcttcctgattcatataagcaatcttgccatcgcagatagtcgcttttaccattccttttactttccagccgttaaacggtgtatttttcccgcgggaaaggaaagtcatagaatcaatgacatactctttttcagggtcaataattgtaacatccgcaggagctcccacttttaaagtacctttattcgaatgaattacctgtgccggattatagctcatcttttctgccatctgcattggagttatgattcctttttctaccagttctgtaattgtaagtgcaacagaagtctccaatccgacaattccaaatggcgcatcttccataggctgatttttttcatctctgctgtgcggtgcatggtctgtactaatcacatcaatgatatcattttttaatccttctaataatgcttctttatcctctttggtacgaagcggaggattcattttatagtttgaatcatctttatcaatttcatcagaagtcaaagtaaaatgatgcgggcagacttctcctgtcacatccagcccttcttcttttgcaaggcggatcatttctacgctgtcttttgtagagcaatgacaaagatgcagttttgctcctgcttcttttgccaataagatatctcttgcgacaatgacatcttccactgcattgctgattcccggtaatcccagttcttttgtatattcatcggaattgacacagccctttgcttctatcaggcttttatcttcacagtgtgcaaataccggaatgttgcactcagcggcaatcttcattgcctctttgtataatcctgcattcattacactttttccatcttcactgattgccggaatcccggcatctgccatttctttaatttcggcaagttcttctcctgcctgtccttttgtaaccgctccaatctgaagtacatgaatcggtgccatctcttttgctttattatgcacatattttacgcggtctgcacagtcaatgaccggcttggtatttggcatggcaagaattgtggtaaacccaccctttgccgctgctttggagcctgacacaatatcctctttgtacgtaagtccagggtcacgcagatgtacatgaaggtcaatcagaccaggcattacataacagcctttggcatcaattaccttatcctgttttgacggattgatttcatcttttatttctttaatctttcctgcttcgatatacaaatcacttatcttatctgtctttgttgcggggtcaattacccgtccgtttttaattaaaatgttcatggactctcctctcctccagcgccttctctgcactctcatcttcttacaaaatcaagtacagaaagattttgagaatacattttattctcttttggttttaatagtaacatacacaaattctttcgtcaattatacttttttccttgacttttaaggcatttttgcatatactgaatcttgtaatgaaatattggatataaataatgaagtgcatttcacaagcttctgattattgtaaattaagcggtttttagagattgtattattttatttataatgaatatactctctaaagaccgctttttattcatataaggagattttgaaaatcctgctttcttttgtttctatccgaaattcaactacttattttttttattttatggaggtaacattatgaacaagggaactgttaaatggttcaacgcagaaaaaggttatggatttatcacaggagaagacggacaggatgtattcgtacatttctctgctatcacaggtgaaggattcaaaactttggaagaaggacaggctgtatcttatgatttaacagaaggtgctcgcggaatgcaggcagctaatgttgttaaattataatttataaggtatctgaatcatttgattttcttataaacagcacaaaaagcggctgtcacatgaaccatgtggcaaccgctttttcttcacattaaatcaaatgtatctgggactccacacattattctgcatctgttgtattcaaagaacttaaataatccgtgattgcagttacatccatctgagtggttacaacttctgcattttcatccggtgttgtgacaacctgatatgcagaatatccaatccagccgactaagagcagagaaacaattgtaattcccagcttttcaacgagtgtcatactctcatcatttttattttttctcttattttttccacggactgctttattttttttatactgatctactttttcctgactcatgttttgattcctcaactttctactgtctattcgctatgtactttctaccgtcatccatttttgcgacgtctgcgctcattatagcacgttttcttttttctggctacaccaaacccagcgttttcaaaagaaagagccagccggtcagagtaaatgccgaacacagtgttgtcaccataacaatactcgaagtcagtatcccttcatgtcccatatttcttgccataacaaaactgctgacggttgtagctgaaccaagcatcactaagattgcaaccaactctgattcacgatatccaagccagactgcaatcggcaaaaaaatggctgcaagcaccactaattttaaagcacttgcaatgagagtcggttttaattttccaagtgccttttttccctcgaaagaagctcccatcgccataagaccaagcggagttgcaagcactgccatatttttcactgttttttgcagaatctctggctgtggaatttttaaaattgcccacacaaaacctgctgcaattccaagaataatcggattcgtaacaattccctttaaagttttttgtaacagggctttatccatttttctctgtcccggttttaacaaagacaggacgattaccgcaaacgcattgtaaagcggtaccgttccgataatcataagcggtgccattccggatgtaccatagatattctggataaatgcaattccaagaattgccgcactgcttcgatatgctccctgcacaaattctccacgttcttctctttttacgacaaagaatgacaaaaccgtcactcctgtaatacttaaaaacgttgcaataaaacagaacaatacaaacccgccattccagctttcacgaatatcaactgctgaaatatcctgaaacaaaagagccggaagtgccacagcaaaggcgaatttattcatctttgccgaaaatgcttcatctatcagcccgactcttttaaaaaagcttccaagaagcattgtaaaaaagataggaagggttgcatttaaactaaaaatcagattatccaacgtctcagtcttcctttaccagcactttcaggatttctgaaatatacatggtatgataatctttctgtggataccattttgtatcaattgtttcatcttcaaagttttccggaagaatgtctccatgatacattttcttgcacactaaaatcagatttgcttcttcaaatgcagctgttccatccacaaagtatggagttaaaccagcttctttgattttatctttgtcacgtccggaaacacttccacagatatttaatgcttttctgtacgattcatcaaaaaatgaaatcgtaaacgtatcatttgcatctacaaattcttttgtatagcgctgtgggcgaatataagtcgttactgcattttttccccacataataccgacgccaccccagcttgcggtcattgtattgcatttttcttcattgcctgcagtaattaacatccattcttttccgatttttgtaaatggattcatctgcaattcttctgcttttacttctttaaatgccatgatttgattctccttgtcattaaatttttattgtcaaaaacatatttatctgccgtataattttgtcatacggcggattttctcttttaattcttcggaaaatgccccttttgtcattctccatttccagttgtctccaagcgtggacggcatattgattcttgcctcacttccaagtcccagaaaatcctggaccggaataatacaggtatctgctgtacttctcatcgcaagtgcaattaaatcccagtgctgttcttcctttggagtgtaaaaactattcatgtaacgcagggcaacctctttgtctccatcggaaagtttctcaaaccagcccgctgttgtatcgttatcatgtgttcctgtataaaccacacagtttctctgatatttataagtcagataatcactgtcctcactcgggtcaaaagcaaactgcagaactttcattcccggatatccgctgtcttttaagagttgaaatacactctctgtcaaaaatcccaagtcctctgcaataatatcaagttcaccaagcttttctttgaccgtgttaaataaatccatacccggacctttttcccagtgtccgtttacggctgtctcatctccataaggaatcgaataatattcgtcaaatccacggaaatggtcgattcttacaatatcatataaatcaaagcagtaagcaattctcttcaaccaccagtcatatcctgttttcttatgatatgcccagttatataatgggtttccccaaagctgtcctgttgcagaaaaagcatccggcgggcatccggccacaccaagcggaagatttttctcatctaactggaataactccggatttgcccaggtatctgcactgtcaaatgcaacataaatcggaacatcacctacaatctgaattccctttttgtgtgcatattcttttacttttgtccactgctcatgaaactcatactgcaaaaattcataaaaattacattcttcttccagttcttttttataatattctaccgcttccggttttctaagacggatctcttcttcccactcaatccagctttttccatcattttgatttttaagtgccatatacagtgcataatccgggagccagtgttgattggctttacaaaattctgtgaatttttcatcggataatatatcagaatttaaaaatgcctgttttaataatacaaatctggaattataaattcttccataatcaatgtaggattcattgtctccataatcagaagcttcgcaggcttcttttgtcagccagcctttttctgccagtgtatccagatcaataaaatacggatttcctgcaaacgtagaaaaggattgatatggggaatctccatagctggtaggaccaagtggcagaatctgccataatttttgtcccgtctcttctaacaagtcaataaattcataagcttcttttgaaaatccaccgattccataaggagatggcaggctcgcaatcggaagcagcattccgtttcttctcatttcaatttcctcattcttcatattgtatttttattaatgtaagccctcttgccggcgccgttgctccggctttttttctgtctttcgcctctatgatttccaacatatcctctggttttcttgccccgcttcccacttcgattaacgttcctgcaagaatccgtaccatattataaagaaaaccacttcctgtaatccgcatacagatttcgtcgtcctctttttttatctgaaaatcataaatggtccgcactgtcgttttgacctgtgcccctgctccgcagaaactcttaaaatcatgttctccaagcagatattctccggcttttcgcattttttccacgtctaatggaagataagtaaaatgagaatacagccgttttgtcggaaccggaaattttttatttaaaatccgatattcatacgttttcctgctgtttcgataacgaggatgaaaatccggttcaacttcttttgacatctgaatccgaatgtcttccggcagtctttgatttaaggcataagaaattttttctcccggcatccttgcacttgtatcaaacacagctacatttccaagtgcatgtactcctgcatccgtacggcttgctccgatggtttcaatcggctcttttagtaattccgataacttttggttaatcacttcctgaactgtaattccatttggctgtacctgccatccacaataatttgttccgtcataggcaatttcaagcatgacccgtttcatgttctattcctcctctgactactctcacaggcaaacctgtgggtttttgccactaatttataacaatatactcaaaaaatcccgagagtacattatactataatacgcaatacaatgtcggcaatcagataaaccagtaaaaccagatatgccataatatcatgattctgatattttaatggtttcatggatgtacgatggtctcctccatgataacagcgggcttccattgccattgccaaatcatctgctcttcgaaatgccgaaataaaaagcggaactaacagcggaattaaatttttcgcttttttgattaaatttcccgattcaaaatctgcccctctggcaatctgtgctttcataattttatccgtctcttccattaaaatcggaataaaacgcagtgcaatcgacatcatcattgcgatttcatgaaccggaactttaattttgttgagcggacgcattaatttttccagaccgtcggtcaactggtttggtgtcgttgtcaatgtcataacagaagaacccatcaccagataaatcagtcggattccgatttttatcgcctgacggattccttcttctgtaatctttaaaatccaaatctgtacaaccacttttccgggaactaagaacaggttaaatgccactgtaaggataaaaataaaaaacaatggctttaaacctttcatcataaatttaaccggaactttggaaagtacaatcaccaccgctaaaaatgctgtggccagcagatacccccataaagaatttgcaacaaacagtgagattaaaaatgcaattgttcctacaaatttcactctcgggtctaagcgatgcaaaattgattttgccggataatactggccaattgtgatatcttttatcatagtatctgtttctccagtgctcttaaaatacttctctttgcttcctcaatcgttgtcgcatttgtatcaaccggaagaccttttgcctgcagatcatgcatgatataggtaatctgcggtgctgcaagccccattgattccaattctttataatgagaaaagacttcttttggcgttccgtcaaatgctttttcccctttattcatcacaatcatgcgctctacatattttgcgatatcttccatactgtgtgaaaccagtaccaccgaaatttttcgttcttcgtgaagcattgcaatctggtctaagatttcatctctgcctcttgggtcaagacccgctgtcggctcgtctaaaatcaatacttccggctccatcgctaaaactccggcaattgccactcttcttttttgtcctccggaaagttcaaatggcgaacttttataagatttctctggaaatccaacatgcgcaagtgccattcttgccttttcttctgcttcttcctgacttgctccaagattttttggaccaaagcagacatcggtaagcacatctgtttcaaacaactgatgttccggatactgaaagaccagcccgactttactgcgaaggtttcgaagcggatatccctctttccagatatcttccccattataagaaacaactcctgaagtcggacggatgagtccgtttaaatgctgaattaacgttgattttccactgccggtatgtccgataactcccataaactgtccctgcggaatctccagactaacgtcttttaatgcatgcatctcataagcggttcccggactgtaagtataggttacattttctaattttatcgacataatgcactcaccagttcctctcttgtcaatattccatccggtatcggcacacctgcctgtttcagttcatacgccaacaaagtaacctgcggtacatccagacgataggattttaactcttctacttttgaaaatacttcccttggtgttccctgcatgacaatttttcctttatccatgacaaatactttatccgccaaagtcacttcttccatgtaatgggtaatcaaaacgactgttatgcctttcttttcgtttaattcctttaccgcctgcagcacttcttttcgtccgtttggatcaagcatcgccgtaggctcatccaaaataatgcactttggctccattgccatcacaccggcaattgccactctctgtttttgtcctccggaaagtttattcggagaatgacttctatatgccgtcataccggttgcctctaaacttttattgactcttctccagatttcatccgtttccacacccatattttccggaccaaatccgacatcttcttccacaatcgaaccaataatctgattatcgggattctgaaataccatgccggctttctgacgtactttccagatttcttcctccgtagaagtattgattccatctactaccattgcaccctctgttggatataaaagcgcattgatatgctttgccagcgtcgatttcccggaaccattatgtccaagaactgcaataaactgtccctgttcaatatccagattaatgtcatcgagcgcacgatgtgtttcttctatatgtccattttcatcatatttataataatcatgcattaactttaatgctttaatgattcccatcgtctatcctctctcttgtaacactctgtcatttccacatacataccgataaacttctatttcttttgcatcctgttccacatgataatcgatttttaaaaatcccagtttttttgccagcgcaatggatgatttgttctccgaatgaatccggcagtaaagatactttgcgcctcgctctttggcttctaaaagaattgcatggcaggcttcatatccatatccctgtctttgataagcttcatcaatcagataacccagttccacaacagaacgaccctgattccagattttcggttcgattcccactcgtccgataattttaccactttgtttttctatcactgcccaatagcccatatcacacaattcatacatatatcttcggtaacttgggaagttttcgatttcttcttctaatgtcttttcctttccctcaaccgcattttctgttgaattctgctcatttaaagcaagcatttgtggtaagtccgcttctgacatttcccgaactaaaagtcgtggggtctcacataccactgctggaagatggtgattgtggcaataaactttttccacaaatctggcatcaatctcttcatagccttcgattatcattgccgcctgacttaagtcctgctttcctgaatccggattaaaatatcccatacaggttatatttgccgcttttgctgcacggcatccattggtagaatcttccacaaccagacattcacttacgtctaattcaagttcctctgctgctgccaaaaagacgtccggtgccggtttcggatgctttacattctctccacttaatattttatcaaagtagtgccgaatatttaaacgttttgtaaccatttgaatataagaaagcggtgaagaagaagcaatcgccattttgtatcccgcattttttaagcgttctaacaactgtggcacgccctctatcatcgggataccctcccgttccaccgtttccgctttaatctttttcatggtatccactaatgccttatcttctctgtcaattccataggtttcatgaagaagattcataagaaatccaagtgtagaaccaatacaaggtttatagacctcataatccaattcaattccacgtgttaaaagtgcttctttccagatacggtaatgtactggttcactgttgatcagcactccgtccatatcaaatataattccctttaacatcctttttctccaaactttaaaagggtactgctttttcacagcaccctttctattttttcaggcattgcacggtgtaaagcgttggaatgcttagctgctataaagcggacattcgcaatccgctttgctacttgctcatgaacgcagtcgcttcgcgctctgtcagtgggagctttcaactcccactgacagaagcatccccctcactcgccgcttagtgctccgcgcacttgaagcagtggaatgcttagctgcgttcaaacagcaattcatccataattttccagatttcttcccttccctgcttggtttcggctgagaatggaatgacctgtgtgcccgcaagcagctcgagtccttgtttcaatgccttcacgtgtttctgtacctggctgcgttttaatttatctacttttgttgcaataataatcggctgataaccattgtgtacaatccagtcatacatcattttgtcatttgctgacgggtcatgccgaatatcaatcagcaaaaagaccgcttttaactgctttgatttctggagataacgttcaattaattttccccactgttcttttactgactgcgaaacctttgcatatccatatcccggcaaatctaccagatacatggcatcattaatattataaaaattaatggtctgtgtcttacccggggaagcactggttcttgccagtgctttacgattcattaatgcattaatcaaagaagattttcccacatttgattttcccgcaaatgcaacctcaggtaactcagtatcaggaagtgtgctggtaattccacacacaatgtccagtgacacattttttataatcatacctgacctcccgtaaatgcttcttttattacttcttccatagagcttacaaagataatattcagtccgtctgtaatttctttttctaattcctctacatccggtttattttctttcggaacaagtaccgttgtaattccggcattttttgccgcaagcagtttttcttttaatcctccgatcggaaggacacgacctcttaaagtaatttcaccggtcattgcaagatttgcttttaccggaatttttgtaattgcagaaagcattgctgtcgccatggtaattccggctgatggaccatcctttggaaccgctccttccggaatatggatatgtatgtcattgtttttaaaaaattctgcatcaatctgatagttctctgcaattgagcggatatagctgattccgatctgtgcagattccttcatgacatctcccatctgtccggtcaatacaaactcaccctgacccggcatcagattcacctcgatttgaagcgtatccccaccaacactggtccatgcaagtccacgtacaatccctatctgatcttcttcatttttcttctggaacgtataacgcgctcttcctaaaaattcttccagattctctttttctactcttacacagctttctttttcttctaagatttttctggctgattttctacagattgttccaatctttcgctccagacttctgacacctgcttctcttgtataagcagtaatcatttctcttaaagcttcatcggaaatttcaagctgcgctgattttaatccgtgtgccttaatctgctttggaatcagatgttcttttgcaatatgccatttttcattttcggtatagctgctgacttcaatgatttccatacggtctaaaagcggacccggaatagtctgtaaatcatttgcagttgcaatgaaaagcacttctgataaatccagaggaatttccacatagtggtcacggaatttatgattctgctcagaatccagcacctccagaagagcggaagaagtatcccctttgtaatcactgctgactttatctatttcatctaacagcatcagaggatttttgactcccgcctgaatcattccatttgcaatacgacccggcattgcgcccacataagttctcctatgtccacggatttctgcctcgtcacgcactccgccaagactgattctgacatattctttattcaacgcatgtgctaccgattttgcaatggaggtttttccggttccgggcggtcctaccagacagagaatcggactttcaccttttttcgtcaatgtccgtaccgcaagaaattccatgatacgctcttttactttttccagaccatagtgttcttcttcaagaatctgatacgctccctgcaggttcttattatcgcgactggtcttgtcccatggcagagacaataacgtttcaatataggtacgtattacccctgactctgccggacttcccacagtatttttaaaccggttgatttcttttgtaatacgttctttgacttctttttttgcctttaatttctttacggtttctaaaaactgctccgcttccgttgcagaattatcttcgcctaattcctcacggatcacttttaactgttcccgtaaaatatattcacgctgatttttgtcgacacgctctttcactttggattgaagtcttgctccgatttccataatctggatttcgtttgtaagaatcattcctacaatttcatagcgttcctcaaggctgactgcctctaaaatcttctgtcgttcttcatagcgaatctgaatatgaattgaaatctggtctaaaactttttccacgttctctaattctaaaatctgaccggcaagttctttgctgatctgcttattggaattacagtaacgtacaaataattctttgatactgcgaagcattgcttcttttaccgtttcatctaagtcttcttccggctcaaaaaccgctatctgcgcctcaagataatttggattttcttctaaagaaaccagctgtgctctctcaattccttctactaaaactcgaacaatgttctttggaagttttaccaattgtttaatttctgcaattgttccaattggatataaatcctcttgaaccggttcttctgtctcaggatttttctgtgtaatcaagagaatcctctgatcctgcatcattgcttgttcaatcgcctgaatcgatttctctctgcttacatcaaagtgaacaatcatatcaggaagaatggtcgttcctctgagggcaaccgccggtaaatgatacattatgtcactcaattcccacacctccttattttcattgatgtattccgttcttatgctgtttccggtttattgcgtttgcgtccgcctttgcttcttcttgtcggaggctgcatttctccatgctcgagttcggcacttcctgttccttctaccacttctttggtaatcttgcaggaacggatggtctcatcggatggaatttcatacattaaatccatcatggtattctccatgatagcgcgaagtcctctcgctccggtttttcttgtcatagatttttctgcaatggcattaattgcggactcatcaaactctaattttacgccatctaattcaaacagtttttcgtactgttttactaaagaatttttcggttcttttaagatacgaaccagagcttctttatccagcgcatccaaagaaacaacaaccggtactcgtccgacaaattccggaatcataccaaattttacaaggtcatgcggcataacttcttttaacacatcaccgatatttcgttcttttttatctgcaatctcagtattaaatccgattgattttgtatccatacgggtttcaataattttatttaagccctcaaatgcaccaccacagataaataaaatattgctggtatcaatctggataaattcctgctgcgggtgttttcttcctccctgaggcggaacacttgcaactgttccttcaataattttcagcagtgcctgctgtaccccttcaccggatacatcacgggtaatggaagtattttctgattttctggtaatcttatcaatttcatcaatgtagataataccatactgtgcacgttctacatcataatctgctgcctgaataatcttaagcagaatattttctacgtcctctcctacataacctgcttctgtcagtgttgtcgcatctgcgattgcaaatggaacatttaacagttttgcaagtgtctgtgcaagcagagtttttccggaacctgtcggtcctaacatcaaaatattactcttctgaagttctacatctgaattactgcctgccaatactcttttataatgattataaactgctacggaaagtacttttttggcttcatcttgtccgattacatagtcatccagaaatgacttaatctcctgtggtttcagcagattaatttcatcgttcatcggttctgcataatctgcactttcttccgcacagatttctgcacagatttccacacactcatcacaaatataagttccgtttggtccggcgatcaatttacgcacctgctcctgtgtttttccacaaaatgagcagcggactttcggttcatttcctttcattgccatttcttttcctttctgttttacttctctttttaatggcgaaaagacccccgagccaaagcgcaggagtcttatcttttgtcttactttttatactcaattatgctgtcaatcagaccataagcctttgcctcttctgcggacatataataatctctttccgtatctctggcaacgacttcataaggctgaccagtatttgcagccagagtctcattcagtttctttttggttttcagaatcatatttgcaacgatttcaatctctgttgcctgaccctttgcaccgccagatggctgatgaatcatgatttctgcattcggaagagcaaaacgttttccttttgcaccacctgcaagaaggaatgctcccatacttgcagccatacctacgcagattgttgatacatcacatttaatataatgcatggtatcataaattccccatcctgctgaaactgaaccacccgggctgttaatgtataactgaatatcttttccaggatcttctgattctaagaacagaagctgagcaataataagacttgcagttgtatcatttacttcttctcctaaaaagataattctgtctttcagcaagcgggaataaatatcataacttctctcgcccctgcttgtctgttcaatcacatatggtactaaactcatgaaactcctcctattctgtcaaacaggttcaaaggactgattaagcctctttattctctacgacttctgttacttttgcagcatctgcaagtaaagtaactgcttcctgaacagctaaatctttcttcatctgttctttttcgtagtcacccattaattcatttaatttttcagctgtcattttatatgcttcagccatttttgcaatttcttcattgactttttcatcagaaatctggatatcttctacttctgcaactttttcaagtaccagacgtgtctggatcgtcttcatagcctgtggtcttaactgttcttccattgctgcacggtcagaacctgtgaactgatagtactggtcaatggaaagtccctgctgctgaagtcttgagataaagttgtttaacagctcttcaatctgaagctgaaccatagcttccggaatatccatctgtgcattttcaattactttatctactactttatcttctttttcacgttttacagctgcttcttttctttcttttaagttcttttcgatatcagctttgtattctgcaaatgtttcaaattcagaaacatcttttgcgaattcatcatctaattccggaagttcttttactttaattgcttttactgtgcatttaaatacagcagcttttcctttgaggtcttctgcatgataatcttccgggaaagtaacgtttacttctttttcttctccgattactgcaccaaccaactgctcttcaaatcccgggatgaaagagttagaaccaattgtcagcggataatcggttccttttccgccttcaaaagcaactccgtcaacgaatccttcaaagtcaagtgttaccatgtctccatcagcaactgctctgtcgtctacgtcgattgttctggagttcttttcctgttcttttttcagttctgctgcaacttcttcttctgttacgtctgctgcggatacttctacttctacacctttatattcacctaaagtaacttccggttttacagcaacttctgctgtaaagatgaaagattttcctttttcaatctgtacaatgtcaattgttggtctggaaacgatgtctaattcgctttcctgtgctgcctttggatattctgtattaatcagaagatttgctgcatcttcaaaaaatacacctactccatacattttttcaatcataacacgtggagcttttcctttacggaatcctggaatgttgatgctttttttgtttctgttgtaaacagtgtttactgctttttcaaaatcttctgctgatacttcaactgtcagctttgccatgtttttttcgagtttttctacctgtacgctcattttaaatgattcctccttgaattctatatgtattgatgcatattaggtattcatgcatttctgcccataaatagaccatttttcatacttacagtcattatcacagtatagcacaaggttttttaaaataccagcatttttttaataaacgattgatttttttatctgatgtgcctttacttcaccttctaactgactaatcagctccagcgcaaacgcaattgccgttccaactcctctgcttgttgtcacattcttatcacgtaccactgcttcttccgaaagaactgccccttttaatttttcctcgcatcccggatagcaggttgcttttctgccttttaaaattccatttgctccaaatactcctggtgcggcacagattgctgctatttttttgtctgcttcattaaattttatcaacaattcggttaaacctttgtgttctcctaaatgcagagttcccggcatcccgcccggcagtacaagcatatctgcatcactgtaatcgacctcttcaaataaccggtctgcactcactttaatcccgtgggagcccgtcacttcaagacttgttccaatcgaaaccataatcacttcttctccggctcttcttaacaaatcaacaacggtcaatccttctacttcttcaaagccctctgctaaaaacacacatacttttgccatgtgacattcctcctgtttgcttttttctcaaattatgatacgatactggtaaatgatatttcaatcatcttataaaaatcaaaggagcattttattttatggaaatcgaaagaaaatatctgattaaaaacctgccattttccctaaatgaatattcttttcacaaaattgaacaggcctatctaaacaccgaccctgttatccgaatccgaaaacaggatgacgattatatctttacttataaaggtcgtggacttatggtaagagaagaatacaatctgccgttaaatgaacaggcttactgtcatcttagagaaaaagccgacggcattattttatccaaaacccgctatcttattccttttaaaacttataccatcgaattagatgtatttgacgccccttatgaaggactgattctcgcagaagttgaatttcctgacgaatcttcggctaattcttttactgcaccggactggtttggagaagatgtcaccttttccaaaatttatcataacagtaccttgtcagccggtaaaacacaggagcccatttaactaaggctcctgcttttttcccttttgttttatctgtcttcgtatccgtctccaggtttcttcctgccttttatccagttctttttcaaattgtatcccatactttctctctaatttccagagataacattctaaaatcactccacaaaaaacacctgccagctttgccaatggattcttactcttccgacagtgttttcttaatcgaaaaattcgttccattttcatcccttctgtcaaaataaaaactattccatgattccttttcttttattttaacaggagagcttttgttttgcaatgttatatattgcaaaattatctcaatttccgactgagataacactccgtggggcgcacattgtccagtggacgatggttctgcgcggaccgtaacgaagtgtagaccgcagcgattctaagaagaatttgtcagcttgtgctgactagattcgtgcgccaagtctcacgaatgttcgacttgaatttttataactgttttgttttctttacacaggcacgaatactttcggaaactgcacttcgcatgcctctttcttctaacacaccaactccctctattgttgttcccgccggtgagcagaccatatcttttaactcacccggatgcatacctgtttctaataccatctttgcacttccatatacagcctgtgccgcaaattcatatgcctgttttcttggcatgccctctgcaactgctccatctgccattgcttcgataaacataaacacaaatgccggtgagcttccgctgactgcgccaaccacgtccagaattttttctgtcacggtatccgcacgtccaaaagaacgaagcagtaccagtgcatcttcaagttctctttctgtaacctctttattcgggcagacacctgtaatgccttctccaaccagcgccggtgtatttggcatggtacggataattttatgtcctgctccaaactgtgcctccaaccattccagtttttttcccgccgcaatcgaaataatcacctgttctgattttatttctgattttatttcctgaattacttcttcacaaaactgaggttttactgctaaaaagatcacatctgcatcctgtactgccttcttattatcgattgtacattcgattccaagtgtttcctgtacttttttagcagagttttctgttttcgtagatgccttgatatcctctttttttaagattcctttttctaatatcccgccaataattgcggttgccatatttccacagcctacaaatcctattttcatgtctgtcaaacctcctgtattgttttacaaactctcaaattctttaaatcaagtgtaataagaattctgagaatacattttttcttattatccaacgttttcttcttttttgcaagtattggctgtgttttttctcttctcaaaagtttgacagttgaacaagtaaaagctcagctttcaaatttttttactcttttactaaacgacagattgttatcatcactttttcaatatccaaaggtttcgccaaatgagcattcatacccacggcaatgcacttttcagcatcttcctggaatgcatttgctgtcatagctataatcggtattgtttttgaatctgaacgttctaatgacctgatttccctcgtagctgtatatccatccataataggcatcatcagctccatcagaattgcatcaaatgttcctgccggtttctctttaaataattccactgcctgctgtccatcctccactctggtaactaacgctcctacatcttcgagaactgtcttcgctatttccgcattcagctcattatcttctgcaatgagaattcttttcccttttattgtgtgaattgcagatgtctttatggcattccgacttccgtatacctcttcttttgatgccatgtcaaaagaaagatctaccgtaaattttgttccaataccctgtctgctttctacctgaatacttccacccatcagctctatcatggatttgataatagaaagtcccaaaccggttcccggcaccttgttttctgtagaggtatgttctctggaaaattcttcatagatatgcggaagatattcttcacttataccaatacccgtatcttcacatgagaaaatacaacgtatctttgaaggattctctgatactgcctcatgtatttctacatggattgaatgtccctccggagtatactttatagcattactgataatattcaacatgatctcctgtaactttgtctgatcacagacagcataatgatgtcttacatctaaaacggtatgatactgcaagttcttctttctgatatcctcttcaaacactgtatttaccctgtgaaataatgcatccatatcctcagcttttaactgcaataccgcagtaccactttcaatccgggccatctccagaacctgattgatgatcattaacaaaagattactggaagactgtatctttcccagatattcttttgcctttttttcattttgcagattcttctccaacaaatcggaaaaacctacaattgcattcatcggagttcgaatatcatggctcatgttaaataaaaatcttgtttttgcctcattggcatttttcgcctgctcagcagatttttccagttctgcttcatattgtctttccctgtgttttttgctggatgtcaaataaaatactgtagcaatcaataatgagaatatataagaaatggcaatacacataatccagtaagaacgtggaatccatccccttgaaggtataatatcaaaataccatgtgttattgggcactgtacattctactgtcagaatgttgtccggcatatcgctctggctctctgccagaataatccggtcgctgctgtctctgtcataggtccaaattctgtaacagaaatctgcatcacttaaataatcaagatttatctcaccaatgaaacgatcccagtcaatcaccagaattacaaacccccagaactcaccctgttctgaattattgtcctgataaaccggattaaaaagcagtgctcctgttcctccctgctttaactgatatggtcctccaagcgtatattttccgctcttcttcgccagaattgcatcctttttccgttcatgctcctgcagcatatccagtccaaaagccccctcatttccctgtttcggataaatgtctgtaacaattccctcaggtgccagttcaaatgcctttatcactccatcttcattcggaatcttttctgccagttcagaaaatgtattttcatccagattttctcctgcactgatataatttcccaaaagttcagagagcatgatatactgatccagccttgccctaactcttttctcagtgatctgcgccatatattttccggttgtcttttcatccttttccaacttatggagcagaaaaacgccaacaatgagtgctgtcaaaacagcaatcaatccaacaatacaacaatgtaattttatctttttatatagttcgctgtcctttttcattctgctattcctctgttatttttttccggtcactgacacgtctgcttaccagcacagaattttcggattgtatctatcagttccggtacctttaacggttttgacaggtgtgcatccatccctgccttcatcgtctttcttttataattatcagctacctgtccctatccgattttctcaaaacaaaaaagcactgtcttttcagacaatgcatcttaaacgttgtaacctactgctattttgcaggttctacagctttgcgtcttagatcttcggctgatttgctgacgaatctttattttttattatacattatttcttgcaatatgtctatcatatcagccagagtaccacgtctataatacttgcataggcgtgggtgaatggctgtgttttattttattccctgatttttaatataatttttcactacatccagagtattttcacttacggttgcaataaaataactgtcagaccaaaaataaggtttccagtaatactttttaagcaatgtatcgccataaagcttacgagctttgcgggacgtctgagtttttattacattgacaagttctgacggagaagtctgcgggtccgcttcaataagcagatgtatgtgatccagttccccgtttaactcaagtatattaaaccctctgctttcagctacataattaatccgttcatagacagcagtttttacatcgccggtaagaaccggatgtctgtattttgttacaagtactatatgatactgcaataaaaaacagctgtgcctgtttgtataatattcgtaccctgttttctttttcataaggatcaaattctcctttacatccaaatatatgtttgctatgattatatcagagataattaatgttttcaacacttacaaaaggagtgcagctatatgtcttataaggtaatccagtgtcagatagcacaggacagcttaatatatgattactgcgacagcaatgctcaaaaagcaaagctgttgtataatgctgcgctctttcgtatcagacagattttcacaggttgggataaagactctcgtacggacaatgagaaagaagtctttgctgaagtagatcttctgcaacagacttatccttctgttaaagtgaaaaaggtcatttcatacggtcaccttgagaaactgatgcgcgttacgcataaccctgacttctttgcaggacttccaatgcagacggcacaggctgttgtcaaacatgcaggaaccgatttctcaaactggctgaaatccttaaaggcttacaagcaggatccgtcaaagtttttaggaaaaccgcagatgccgcactaccagaagcgtaagattatcacatttggtattacgaatcaggatgctgtattatatcccgcagatcatggtgttaatttaaaactcccgggtagaaaggaacgcctttatctttcaaatgtagaagcggattccgtcctcaaagaggttaaaattaagccttattatggaagatatatcctgtgccttaccctcgaaagtgaaaattttgccgcagataatacagacatgcccaacatatgcgccatagactttggtgtgagcaacttcgcagctgtcgtatgcaatgatggttcatcaatgctgtacaagggcggagcggttctgtcagagtgccagtggtttcacaaaaagagagctaaagctgtcagcattatcacaaaaggacatgaacacatgcatgccagctccaggtacctgagcgccttaagcaggcatcataccgatttcattaaggaccagtgtcataaaatcagccgcagcattataaactactgcatggaacatcacgccggtacacttgttcttggcgaaaacaaacgctggaaacaggactgcgacatgggttcacagaacaaccagaactttgtctcaatgcctatagggctgctcaaacagatgattatttacaaagcatctgatgccggaataaagacaatcatgcaggaagagtcatacacctcacaggctgacataacagcaatggactacattcctgtttatggcgttgatgccgaaaacgcagtattttctggcaggcgcataagccgcagtctctaccgctgctttaacggcatgatcatcaatgccgactgcaacggtgccgcaaatatcatgcgcaaggccataacggatgcatggaacagcataactgatttttcatttctcgcatcacctgaagtgtcaggattccacgaactgaatcccctaagtatttccgtaaaagggatagcggccgcgtgaacggcctcggcaggtggtggacagcttatttttaggttcgaaagacgacttataaagtgtcctgttgctacccaaataccacttccataggagctatgcaccgcatgggagttggtaattcattgcaaatctgtcttcttgctacttagtttactgggcttgtagccgttttgttgctttacaactgtcagagatgtgattatctaacgttttcttcttttttgcaagtattagctgtgttttttctcttctcatggtataatatgatgtaagtgtcaaaagtataaattgcggttgtgcttgcacaaaaagcaatttatacttaatattatattttaaaactaataaaaaaaaactaagactattaaaggagctctcaattatgagtaatgaattattttctgtttatcactgcaaatcctgcaataaaatcgaagtcacccagtatatctctccggaacaaatcaaagaatttggatttaccgcagaagaattaaaaccaagctgtccagccaccggaagctatgacttagaagaacttggccagatgacagacaaagaactgcgtcatttttcctacagcgatgtagagggtgtaaaagaatacttaaaaaaccgcagtcagtccggtccgaaactataataaaagccatccggcatgcttcttgtatgccggatgttttattcacaacattttgctaagcgagtcactaccatttctatcttctccaattcaatcgaagaataattcatgacataagtgttttggatttcttcccgattttccttatagtacgcagacaatggagacagtttaattccctgcgcttttgcgttctccattaattgttcctgtggctttttcgtttcaatcttcatcagaaaatgagctcctgcctcttctccggaaatggaaacatattggttcaaacgactttttttaatggtctctacaatggtatttcgtttattatgataataatttcgtagccggttaatgtgcttttcaaaataaccttcttcaataaattttgccagcgtatactgttcaaaattagaaaccgtacaagaataaaacgacagttttttataatactgctgaaaaagttctcttggaaggatcatatagctgatacgcacggtggacgcaagtgtttttgtaaaggtattcatataaatcactttgtcagacacatccatgctttgcagcgttggaatcggctgaccacttaagcgcagttcactgtcataatcatcttcaataatataacgattttctgattttgcagcccagccgagcagttcatagcgtctgctgaccggcatcacaattcctgtcggataatgatgagatggcgaaatgtgtgcaatatcgacttgattttcttccagcttagaaatttccacgccttcgttatccatatcaatatacttacagagcactttataactttgatagatttttccaattttccgatatcccggattttccacagcataaatcttttcatttcccaaaagctggattaacaagccatataaatattctgttccggcacctacaataatctgttccggtaacaccgtcatgccacggaactcttttaaatgctttgcaatggcttctcttagaaaaaacacaccgccgcaggggggattaatcataagctgcatctgattttcatttaaaacttcccggattgttctggtccagatggtaaatggaaacaattcactctctgtctgattacttgtaaaatctgccagatatgcattttcccctccggtaagcggtaccatttcctttacaaaggttttcttttcaatttcaatgacctgcttaaaatccgtaacataaaatccttttttcggaatggaataaatataaccttccgcaatcagctgttcataagcattttctaccgtaatgacactgatacccagattttttgcaaaacttctcttagacggcagtttctcccctgccttaatacttcccagtaaaatatcatttttgatgcatttatacagatattcataaagggaatctgaccctatatttgtaaaattataagtaagcatattgtcttatccctccaatctgaccttactgaatatatttattttggcaatttaagtagactcactttagaattataatctacccatgcgatttcgtaaatgattttttaggaggcttttcaaaatggaaaacagatatgaattaaataaagaactggcacagatgttaaaaggtggcgttatcatggatgttactacaccggaacaggcaaaaattgcagaagaggcaggtgcctgtgccgttatggcactggaaagaattccggcagacatccgtgcagcaggcggtgtctcaagaatgagtgacccaaaaatgattcgcggaattcaggaagctgtttctattccggttatggcaaagtgccgtattggacatttcgtagaagcacagattcttgaagcaattgaaattgattacattgatgaaagtgaagtattatctcctgcagatgatgtttatcatatcaataaaagaaactttaaagttccttttgtatgcggtgcaaaggatttaggcgaagcattaagaagaattaatgaaggagcttccatgattcgtaccaaaggcgaacctggtaccggtgatgttgtccaggcagtccgccacatgcgcaaaatgaatagtgcgattgctcagattaaaggaatgcgtgaagatgaattatttgaagctgcaaaacagatgcaggttccttacgaattaattgaatatgttcatgtaaacggcaaattgccggttgtaaacttcgcagcaggcggcgttgcaactcctgctgatgccgcacttatgatgcagcttggcgcagaaggtgtttttgtcggttccggtatcttcaaatccggtgacccgaaaaaacgtgccaacgcaattgtaaaagcggttacaaactataccgatgcaaaaatgattgctgaactgtccgctgacttaggagaagccatggtcggaatcaacgagcaggaaattgaattactgatggcagaaagaggcaaataatgacaatcgcagtactcgccgttcaaggcgcttttattgaacacgaaaaaaaattagaacatcttggtgcagactgtattgaactgagaagagcagaggacttaaatcagcactatgatggaattgtactgcccggaggagaaagtaccgttcagggaaaattaatgaaagaacttggtatgttcgatatcataaaatcccagattaaaaatagcatgccggttcttgctacctgcgccggaatgattctgcttgccgataaactggaagcagaatccaaagtacatcttcagacgattccgatgaccgtaaaacgaaacgcttacggtcgccagcttggaagttttcatacaaacgcaacgataaaaggaatcggagaagttccaatgacttttatccgtgccccttacgtttcccaggtttctgatgaagtcgaaattttatctgttgtagaagaacgaatcgtagcagtccgctatcaaaaacagattgcccttgcctttcatccggaacttgataacgatttaagaatccacgaaatgtttctctctttatgtaagtgaactactcggcaactgagttaccagagcatctgaaatctggcgggataccgccttttttcagggtgcgtccatgacaccaatactgcttgcctttcggctatgcagctacttttattatatctggtttttttagtccggttacggacagttccttctgttttccggatacggaaagatatttccgcaggatattaaatgcgcctaccgcatctgcattgtatcttactccgtccgttacatacatgccccgttcttttcggtttgatgcttctgcatatctttttgatacttctggtgataacgggctgcactggctggtataactttcttcttgttttatcaatggaatcccataccgtttcagcttatattccagcatgatatacaacttattatacggcaggctgtgaaacttctggtttatcttgtgtcccatatctttttctttccggatatttcggatgtctcccacaaccacacagcggatctcttcttttctgcagtattctgcgatccatctggtcactttgtgaagataatccttcactgcattctgctttttcctgtaaagtctctggatatgtttcgatgattttggatattttattcctctttccgattgctgtgtataccacactgactgcactctggcgatctctttatgaagatatctttccaaagaaagatattttcttcccaggataaaagcccggccatttccagaatcataacaggtcatcagattatgaatccccagatctatagataagtaatgtccattctgggaaagctgttccggctcttcactctcataaataacaataagggcgcattttccattctccggtggatagatctgcaattgttttatatggtccatgctcctgaaaatcttattttcaagatatagaaatttctcatggatcccgtatgtttcttccatatagcttttcagattctttggcagagacagtctcagctggtctgaacctttctcatgctgaatccccatctgcatatatgtaaccgggatatttccctgtttaaaacggggcggatttggatctttgatccctccagtcttttttaggacataaaaggatttccatgctttgtccagctgcttgcagatctcctgcgctgtctgtgacagaagctgtttataccacagatttcctttatgtgcttttttctgataataccagtcaggatacttttccagtcccagctctttataatgacgccgttcgtagttgcagatattccagagtttggaggctgcataacacatatgccctatgatattggaatattcctgactgatctttatggatgttttatgtgacagcagcattcctcttcctcctttaatcactgcgcagatagggattcacactccatcttgaatcaatacgatttgctctgatgttcaatataacggcggatattttcttcagatacagatccgatcgtttccacataataagaatggttccacagctctcctttccatagctggtttcttatttccggaaaacgttcgaacagttttctgccagtgatccctttcaaatacttaacgattgctgttatagaaagttttggtggagctgatacaaagcagtggacatggtcgccttcaccacattcaaataaatgaacagtaaagcccttgtcctcagcaatctgctgcaccagttcctgaaggtattcctcaatttctggttttaatatcttccgtcggtatttcactgaccacaccatatggtagttaatattacacacacaagtcctataatgtatcaggttttctttcatgcatatagtatatcatattgaattgtaatgcgcaataattatccgaacatattttcgtttttattgtataccgtttacggcatttattttttatatttatattttaacagaggatgaggattattatactgtttgcattgtgcagatatgcacactcctgcgctttcatctcggtaattgaattgccgaggattcccgcttattgtcctaaataaaagaaatgccagacagccatattttcagagctgtctggcatttcttattagcgttcttcctgtttaaacattacaataaatccgacaagcaatagcaaacaggaaatccaaattgtatgcatacctaatattggaataaacctgcttccaattcctgcacctaatgcaaacaaaaaaatgattccaaaataatggaatgatttataaagcatctgtttattatgattctgctgataagaacataatgcctccattccacttctcagattaccaatacacattgtactggcaaatgcatagctggcaacttttctaaaggattgaacctgcattgcacaggaaaaggacaccagtgcattggcaatcagattttgttcttccggcataaatccaaccaaaaacaacaaaacaatttcaatcagtaaaataatctgtctccaatgaagtctctgggcattttgaaaagactgacgaatccacgtcgcaactgccactccaaatgcaaaaaacaaaaccggaaccaggtaacgaatcgtaagttcccagttacatgcaaatacattctggctaaataatacaatatttcctgtctgcgcatttgcaaatacttcacctcgtgaaacataagtatacacatcctgaagcccgccggatatggacagtacagcggccgtcaaaaatgattctgacatctgtcttcctacatgttgaaaatttaaagttctcattttatctccccaattaatttattattctttcactcaagtacagtacctgaatgttttatccgtaataattcttgcaaatataagtcctaaaggcaatgctaaaatgataagcagtgccgatgcaagccacgaagctgccgctgtcagattcataattccaagattataaaatcctttatatagatatagtccgggaaccataattacaattgatggaactgtaatggaaattcttggataacctgccataccttttaacgttgaagcaagaatccccgcaaaaaaggctccaataaaggctgctgctgccgggggcagagataagaggtcaatcagctccaatctcgttgtatttgatatcgcacctattataccagcggcagcggcaagacgaatagggctgttaaacataatagaaaatcctaaaaccccacagaaactggcaagcaaacgaaatacaatccactgccataaggcaaactctaaaggcaaaaatggtattggtttaagccccagtaccatagcaagtatccatgctgtcatcgttgcaaccgttacaataatcattgaataagcaagcctctctgttcctgaacgcatatccagctttgcaagatcaattccactcgtaataaatggaaatcccggaataataaacagcatagaacaaatataccctgcttcatgctgtaaattcacagcaaaaataagctccaataattttaacaaaaccgtataagtaagacaggctgtggataccgaagaaatgatacataaaaacagcgtaaaatgatgttttgaaagtttacacctgatatagtttcctattcctgcacctgcaaatgcacataacatttctacaattcctccgccaagaaggaaagtaaatgcaccacaagccaatgctgcgaatacagctaaaataacaggagaatatagagcatgaattttttcaatttcatccagccttgaatgaattttttcacaactttgcccgatttcatctgttgcgaaattgcttaccagcttttccagacgattcagctgcgacgtatttacccctgtattggtcagacataaagactgactaaaactatcatttccatcaaaacatgtataattaattgacattaacccaatatcaactgtacaagtgacattcataagttccgataattcattcatggaactacggacacgccatgctcctgtgccacaggcaagcatcataattccaactcttccaattacagatgctttttctgacagactcgcccctgtaattggtgttaaatcttttttatccgtatattcatgccagaggacatccatatgatttttcttaattgtcgcttcattcttttttgtcctcatatttttccctcttttcgtctataaatcaaagctgtctgttcctgccatttttatcatttcttctcgacatgtcagcaccagtccatctattacttcaagatgctgaagcatttttgattcaaactgatggattggcaaaagaatgcctaattcatcaaacgattttccgggtttactgcctgtttcctgaccataatatactacagctgaaaatgcttctttttgtattttgtggaaaacagaccagataatatcatatgcctgtgcttcggtcagattcaatttctttgtatccggaagcgcatataagatgagaattcctctctctttattttcctgtttctcgcaaatattcatacctgaagtgtaatatctgaccagattatatccatctgccagatataatttggaacgcggagctgctttatgcatctgataaatttcccgaaattttttatattcatgttttgaaacaactgctttttcttcttctaataaatctccgtccacatcggtaagaagaacgggattctccccgcattttccatggaaccgtctcggtattaaataagactcctttaataaatcaaacatactgcgattacagagttcaagcaaaagtgcactcacatctccatttttatatgcattcagcaaaacttccgcaaaatgatgcggatccggatccatatatcgattgtcatcacataaatgatcataaaatgtctccattaatctttcacaggattgtttagaagaaagaatcctcgaaaatatattttcaacttcttcttctcgtggtaatactaatgacataacaccatctccctatatttctcttgtttttttattctaaaaagattataatttcatattaggaataagtaaaagatatcattgatataatagaaatatttttttgatatgtcaaggagttttcatatgaatgtaaattttgaatattataaaattttttattatgtggcaaaatacaataattttactaaagctgcccatgttctgaataacagccagccaaatatcacacgtgcaatgaactgtttggaacacgaactcaactgcacattatttgtccggacaaaccgtggagtctgtttaacaccagaaggcgaacgactttttacaagagtttctgccgccatgactcaacttcagctggcagaagaagaactctctgacagtgttagactagaacacggcagcatttctatcggtgcaagtgaaaccgcactgaatatttatttactggaacatctaaaaaaatttcatatcgcttatcccggtgttcgtttaaaaatctgtaatcattctactccacaagctattcgttctgtacgaagcggtgagatcgattttgcggttgtcacaactccaactcagcttgatgcaccattaaaagagttaaaactaaaatcttttcaggaaattttaatcggagggaaaacgtttacctcccttgccactcaaaaattttttctgaaagacctgataaaatatccttttatttgtcttggcttagaaacagccacctatcatttttactataacctgtttctttcccatggaatcgagttaattcccgatacagaagctgcaacaactgaccagattcttccattagtaaaaaacgaactgggacttgcttttctgccagaagagatggcaaaagaagcacttcaaagacaggatattgttcagatttctctaaaagataaggttccgaaacgtcatgtatgtatggtatatgattctaaacgaccaatgagtattgctgcacaaaaattaaaaaagattcttcttgaagaaaaaaagctatagtgttaaccccactacagctttttttatattattgatttacatggaaattaatccaaacgcatttgccactgaactgattaaaataattgccgcaaaaatcggacataaatatttaatcataaaacggaaaatctgtcttctcttaaatggatgtccctcttgtaccacttcttcttcaattttatcgactcctaccactcttgatatcaacagacaagtagcaatcgctgcaatcggcatcataacagagtttgtcaggaaatcaaagaaatctaaaaactgcattccaatgattttaacaccggcaagcggaccatagccaagacaagatagtgtaccaagtaaaaccataatcgcacccattac

SEQ ID NO: 6 - DNA, 6524 bp, Blautia stercoris strain 830 plasmid
taaagtgttaccactttagaacttgtgagggtggcaagccccccttcaatcccccttgaagcagagccgaaaggctcataatgtgacggtggtagcaccgaagaaagtgaggtcgcaaatgaaaatcagcggagcaaaaacaatagcggaatacaaagaaatcagagccaagaaaattcagaaatggattgatagccattttgttgaaggttctgtaaagtgggaatttgacggagcaaatgcgataaaggtaacggacaagaccggcgatagcatgttagtacagttgtccgaaattgattaacaggagggaaacaaaagtgacagtaagaaattttttgaaattgcatgagggcggtgtggcttgcgtatcaatccagcaagaaccatacgaccatgaaaagcatggatatgtaaagacgtacttcgaggaagcagcacaagaggatattcttgcatctgatacattcaagaagatagcaaacaagcaagtagaccattttaatatcattggcggtggaatgtataaagtcgagttgtgcatttatttggaggaagaataatggcgaataaaagcagacctaagcagttatcattccgagtaagtgaagaagaataccagcagttacaggagaagatttcaaagagcggaaagaaccagcaggagtatatcctttcctgtgtgctggagaagcagattgtgaatacggacggtatcaaggaacttatcccggaactgaaacggatagggaacaacctcaaccaaatagcaaagcggtgtaatgaggggggaatgttgccgagtgaagcggaagtgcggaagcatggagaggagctgaacaaagtatggcagtcattaaggcggtatcttcaaaggcgggcatagggcacgccatagattatgtgacgaaaaaagaaaagacagaggagaagcttgtcagtggtctgcattgtgagccggagacagtcaaggaagaaatgcaagccacaaaggagctgtggggcaagacagacggaagaacctataagcattatgtgcagtcctaccatgaggacgaggaaataaccccggagcaggctcacaagaacgctatcgagctggcggagcatacaaaggcatggaaagggcatgaagttctgatagccacgcatatagacaaggggcatatacatacgcactttatagtcaattccgtaaattatgagaacggtcataagctccaatggagtaagcacgaccttaaagacttaaaggaacggtgcaacgaacagagcagggaacagggcttgcatgtgccggagaaaggaaagacatttgctggagaagcccgggaagaaacggtggcatggagtaaagacacctaccagcttttgaaacaagcagagcagggaaaggtcaaaagttatgtgcaggatattgccctggcggtactggactgtaaggaaacagcgatcagccggcaaacctttatccggctgatgaatgaaagagggtacggagtggactggcaggacagccataagtacatcacatataccgacttagccagggaacaggcaggagaaaaggcttgtaaaatcagggataacaagctggaaaaatactacaatatggatttcggaaaggagagcatggagcatgagtttgagagaaatgcacgaacagcagaagcagagcagtccaagagagcaacttcaagagttaaaccgacagagccggacagagctggaaaacagtttgctcaaagaagcgttggcgatgtcgagcgagaactgcgaggaattgatgaagcagtcaaatcaagaacaagtaagggcagagcagaacaggcagagagacgcagagcagaacaggaagctcatcagcgagctgaagcagagcgtagagctactgaagaacagcaacgaattgcttcaagacgctatatcgggcgagattgggagcttgaaagatgaggttaaggaaaataccgtccaagaggttagaaaggcgttacaggcgaatatagaggctatacagagggcgacaaagcttcttgagaagcagtctgatacacttacgagcgtgatgaagcagaaactccgggagctggaggaaagtaagaacagctttttcagatatgagggcttgaaactgtacctgttttggggtggcatggtctgtaatattttagtatttcttatgctagcgtctagcatgtttggtaggtgaaaatatatctagttagattaaaaaggtgcaaaaacctattgataagattagcggtcaaggcgagagggagtgaggtgtaggtattgacaccccaaaggcactcccttatacttgagagaaaagggtgcaaaaacctattgataagattagcggtcaaggcgagagggagtgaggtgtaaaagactatggcaaaatacaccaaaaggagagataaaagagggtatgagtggaagtctgcttatcgggagaaagaagcccttatgctggagaggggatacccggaagtaagtcctcatgatttctatcgggagttgtttccggctggcagtctccagcaagagccggaggacggaaaaggcaatattatagcgacacagattagaccgtccggcaaaggaagaacccggcagtgggtaattgatgatagtctgaaaatgttggataaggtcgtaggggataggtttgggctgataccgcctattagtttttacggaaagtcacacacgaaagagaacgctcatgagctgtttgcggtggtggtggacgtggactatgtaggcaaacagcagttaaagaacctgttgaagcagtttgggaatggtgtgcagctttgtccgacttatcttgtcagctccggcaagggggtacatctttactatttcttgcaggagccggttcagttgtatcgaaacagggaagaagtgcttgcggagctaaaagaagcccttatccggcggctatggaatgataccagctctatccgtccggacagcccggatataaccggaatttatcaggggtttcggtgtgtagggagtcagtcgaagctgggtgcagatttcccagtaaaagcctataagctgtcagagaaccgttacacgctggaggacataaaagccagcataccgagctgtaaggtagaccttgctccgttgtatgagaagccgagaagaagaagtaccgttacgctggaagaagcaaaggaactgtacccggaatggtatgagaagcggatcgtgcagggagagccgaagcagcaaagtaagaagcagggcggtacgtgggtatgtaacgaagctttatatgaatggtggaaacggaaaataaccgaggaagtgaaagctggagggcgttacttttccattatggcgttatgctcttatggcttgaagtgtggcatatctgagcagaagatacggagagacgcctatgcgttcctggaccatttagagagccttaccgaggacgaggacaaccatttcagccgggcagatgtaaaagacgctctccgggcattgaaaggggacagaaaaaggctgtcaacgatagcaagccgggaatggatagaggacaacacaaaggttacgataccagcaaataagcgaaattacagaaaacaagaggctcatttatatcttgcaaggcgaaaaaaagaggatatgaaagttataggcgaagtagtaaaagagggcagaccaacagcagagcggacagtcagagaatggcaggagagccacccgacaggaaagaaagcggactgcatccgagagacaggacttgcaaagcataccgtttataagtggtggaaagatataaacaatgaaaatatatagggaaaaaggagttatttaataactcctttttccctattgtctattgctgaagatttgaggaaaaatgaaggaattttgataaaaaaagataatttatcaaatatattaaagccaaggttattattccaataatgatgctaataggcaatattttttttataaatagtgttgcaagagacgttcctaaaagaaacgcagatccatatggaataacaatattcaacataaaaattttattatgtttttttcgtaaggttgattgattatggattaaaaaacagaggcgttgaggatatcctgattgcatgcgttgatggtttaaatggatttccacaggcaatcgaggctgtttatccaaaaacagagattcagcagtgtatcatccatcagatccgtaattcaacgaagtttgtttcatacaaagacatcaaaaaactgatggctgatctgaagcttgtatatgcagctccgacggaagaaaccgctttaaatgaactggaactgttcaaggataaatgggattccaagtacccaaaaatctataaatcctggcatgataattgggcaaccctgtccacttatttcaaatatccggaggcagtaagacggctgatttataccacaaatgccattgaaggattcaaccgccagctccggaaagtgactaaaagcaaggcggtatttccgtcggatgacagccttttgaaaatgctgtatctggcaaccatggatatcacgaaaaaatggaccggacacaggcaggactggggacagatccattcccagcttgaaatttattttgaagaacgtctggcagggcggaacctgtaaagcagtcaattttaggcaggttttattgacatgcctaaaaactactgtataatgcagatatgggcagaatccggaaaatcggctctgcccattgtaactattcacaaatcttatatcagtttttaacgtttacacaaaacttgaaacggtctctaaaattttgtataataggaattgaagttaaattagatgctaaaaatttgtaattaagaaggagggattcgtcatgttggtattccaaatgcgtaatgtagataaaacatctactgttttgaaacagactaaaaacagtgattacgcagataaataaatacgttagattaattcctaccagtgactaatcttatgactttttaaacagataactaaaattacaaacaaatcgtttaacttctgtatttatttacagatgtaatcacttcaggagtgattacatgaacaaaaatataaaatattctcaaaactttttaacgagtgaaaaagtactcaaccaaataataaaacaattgaatttaaaagaaaccgataccgtttacgaaattggaacaggtaaagggcatttaacgacgaaactggctaaaataagtaaacaggtaacgtctattgaattagacagtcatctattcaacttatcgtcagaaaaattaaaactgaatactcgtgtcactttaattcaccaagatattctacagtttcaattccctaacaaacagaggtataaaattgttgggaatattccttaccatttaagcacacaaattattaaaaaagtggtttttgaaagccgtgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcattttcatcaagcaatgaaacacgccaaagtaaacaatttaagtaccattacttatgagcaagtattgtctatttttaatagttatctattatttaacgggaggaaataattctatgagtcgcttttgtaaatttggaaagttacacgttactaaagggaatggagataaattattagatataacagcgacaactaacctaacggaggctcaaccgtaaaatgagaagaacccccagtagtggctgctactgggggttcgttttgtgtctacgtgacacattatatcttttcttagctattgccattatagcatatgctctcaggcaaatcaagtttacgcaattattatattttttatacgtatcactctattttctccgcaatttttatttttgtgtattttatacattttttttttttttaattatttattcagcatattgatatttatatgtttcctatctccgtctaaccatttgcaaatatagtagccaactacacttgccagtacggaaacaagaaaagatataatttctgacacgtagacacaccccctttctgttgccagaatgggcgcgacaacgctagatattatatcacaggggcagaaatgccacaagaagccatttccccttgtttatcatcaaagccataaggaaaagagtgtcaagggcggtcatagaccgcagcgtttacccttgatactcttttttgttggcaatcatgctggaggggaaaacggctgtccgtccgttccgttacttccccctgtgcttcattgtccgttccggcggaagaaagtaaa

SEQ ID NO: 7 - DNA, 1458 bp, Blautia hydrogenotrophica strain S5a36
  n 1416: a, t, c or g
gatgaacgctggcggcgtgcttaacacatgcaagtcgaacgaagcgatagagaacggagatttcggttgaagttttctattgactgagtggcggacgggtgagtaacgcgtgggtaacctgccctatacagggggataacagttagaaatgactgctaataccgcataagcgcacagcttcgcatgaagcggtgtgaaaaactgaggtggtataggatggacccgcgttggattagctagttggtgaggtaacggcccaccaaggcgacgatccatagccggcctgagagggtgaacggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagaaagtgacggtacctgactaagaagccccggctaattacgtgccagcagccgcggtaatacgtaaggggcaagcgttatccggatttactgggtgtaaagggagcgtagacggtttggcaagtctgatgtgaaaggcatgggctcaacctgtggactgcattggaaactgtcagacttgagtgccggagaggcaagcggaattcctagtgtagcggtgaaatgcgtagatattaggaggaacaccagtggcgaaggcggcctgctggacggtaactgacgttgaggctcgaaagcgtggggagcaaacaggattagataccctggtagtccacgctgtaaacgatgaatactaggtgtcgggtggcaaagccattcggtgccgcagcaaacgcaataagtattcccacctggggagtacgttcgcaagaatgaaactcaaaggaattgacggggacccgcacaagcggtggagcatgtggtttaattcgaagcaacgcgaagaaccttaccaaatcttgacatccctctgaccgggaagtaatgttcccttttcttcggaacagaggagacaggtggtgcatggttgtcgtcagctcgtgtcgtgagatgttgggttaagtcccgcaacgagcgcaacccttattcttagtagccagcaggtagagctgggcactctagggagactgccagggataacctggaggaaggtggggatgacgtcaaatcatcatgccccttatgatttgggctacacacgtgctacaatggcgtaaacaaagggaagcgaaggggtgacctggagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccnaaaggagggagctgccgaaggtgggactgataactggggtga
